(12) United States Patent
Guffy et al.

(10) Patent No.: US 11,708,568 B2
(45) Date of Patent: *Jul. 25, 2023

(54) OPTIMIZED PROTEIN LINKERS AND METHODS OF USE

(71) Applicant: Pairwise Plants Services, Inc., Durham, NC (US)

(72) Inventors: Sharon Leigh Guffy, Chapel Hill, NC (US); Joseph Matthew Watts, Cary, NC (US)

(73) Assignee: Pairwise Plants Services, Inc., Durham, NC (US)

(*) Notice: Subject to any disclaimer, the term of this patent is extended or adjusted under 35 U.S.C. 154(b) by 204 days.

This patent is subject to a terminal disclaimer.

(21) Appl. No.: 17/354,220

(22) Filed: Jun. 22, 2021

(65) Prior Publication Data

US 2021/0355466 A1 Nov. 18, 2021

Related U.S. Application Data

(63) Continuation of application No. 16/932,294, filed on Jul. 17, 2020, now Pat. No. 11,072,785.

(60) Provisional application No. 62/876,275, filed on Jul. 19, 2019.

(51) Int. Cl.
| | | |
|---|---|---|
| *C12N 9/22* | (2006.01) | |
| *C07K 14/00* | (2006.01) | |
| *C12N 9/78* | (2006.01) | |
| *C12N 15/90* | (2006.01) | |
| *C12N 15/11* | (2006.01) | |

(52) U.S. Cl.
CPC .............. *C12N 9/22* (2013.01); *C07K 14/001* (2013.01); *C12N 9/78* (2013.01); *C12N 15/11* (2013.01); *C12N 15/907* (2013.01); *C12Y 305/04001* (2013.01); *C07K 2319/80* (2013.01); *C12N 2310/20* (2017.05); *C12N 2310/3513* (2013.01)

(58) Field of Classification Search
None
See application file for complete search history.

(56) References Cited

U.S. PATENT DOCUMENTS

| 11,072,785 | B2 * | 7/2021 | Guffy .................. C12N 9/22 |
| 2007/0027309 | A1 | 2/2007 | Weinstock et al. |
| 2007/0044171 | A1 | 2/2007 | Kovalic et al. |
| 2011/0182862 | A1 | 7/2011 | Green et al. |
| 2018/0237787 | A1 * | 8/2018 | Maianti .............. C12N 15/113 |
| 2018/0245095 | A1 | 8/2018 | Abad et al. |
| 2018/0312828 | A1 * | 11/2018 | Liu .................... C12N 15/11 |
| 2020/0392473 | A1 * | 12/2020 | Zhang ................ C12N 15/8203 |

FOREIGN PATENT DOCUMENTS

| WO | 2005049642 A2 | 6/2005 |
| WO | 2014020129 A2 | 2/2014 |
| WO | 2018027078 A1 | 2/2018 |
| WO | 2019051097 A1 | 3/2019 |
| WO | 2019120310 A1 | 6/2019 |

OTHER PUBLICATIONS

Chen et al. (2013) Fusion protein linkers: Property, design and functionality. Advanced Drug Delivery Reviews, 65:1357-1369 (Year: 2013).*
Chen et al. "Fusion protein linkers: Property, design and functionality" Advanced Drug Delivery Reviews, 65:1357-1369 (2013).
Notification of Transmittal of International Search Report and Written Opinion corresponding to International Application No. PCT/US2020/042553, dated Oct. 28, 2020, 14 Pages.
Bird, R., et al., "Single-chain antigen-binding proteins", Science, 242:423-426 1988.
Komor, A.C., et al., "Programmable editing of a target base in genomic DNA without double-stranded DNA cleavage", Nature, 533:420-424 2016.
Li, X., et al., "Base editing with a Cpf1-cytidine deaminase fusion", Nature Biotechnology, 36:324-327 2018.
Anders, C., Niewoehner, O., Duerst, A. & Jinek, M. Structural basis of PAM-dependent target DNA recognition by the Cas9 endonuclease. Nature 513, 569-573 (2014).
Conticello, S. G. The AID/APOBEC family of nucleic acid mutators. Genome Biol 9, 229 (2008).
Gaudelli, N. M. et al. Programmable base editing of A•T to G•C in genomic DNA without DNA cleavage. Nature 551, 464-471 (2017).
Hua, K., Tao, X., Yuan, F., Wang, D. & Zhu, J.-K. Precise A•T to G•C base editing in the rice genome. Mol Plant 11, 627-630 (2018).
International Search Report and Written Opinion corresponding to International Application No. PCTUS2021042457, dated Oct. 8, 2021, 11 pages.
Kim, J. et al. Structural and Kinetic Characterization of *Escherichia coli* TadA, the Wobble-Specific tRNA Deaminase†. Biochemistry—us 45, 6407-6416 (2006).
Koblan, L. W. et al. Improving cytidine and adenine base editors by expression optimization and ancestral reconstruction. Nat Biotechnol 36(9): 843-846 (2018).
Komor, A. C. et al. Improved base excision repair inhibition and bacteriophage Mu Gam protein yields C:G-to-T:A base editors with higher efficiency and product purity. Sci Adv 3, eaao4774 (2017).
Malzahn, A. A. et al. Application of CRISPR-Cas12a temperature sensitivity for improved genome editing in rice, maize, and *Arabidopsis*. Bmc Biol 17, 9 (2019).
Rees, H. A. & Liu, D. R. Base editing: precision chemistry on the genome and transcriptome of living cells. Nat Rev Genet 19, 1 (2018).

(Continued)

*Primary Examiner* — Neil P Hammell
*Assistant Examiner* — Tiffany Nicole Grooms
(74) *Attorney, Agent, or Firm* — Myers Bigel, P.A.

(57) ABSTRACT

The invention relates to peptide linkers and fusion proteins comprising linkers designed for optimizing the activity of the proteins comprised therein, and methods for using the same. The invention further relates to newly designed Cas12a-based cytosine base editors.

23 Claims, 26 Drawing Sheets

Specification includes a Sequence Listing.

(56) References Cited

OTHER PUBLICATIONS

Richter et al. "Phage-assisted evolution of an adenine base editor with improved Cas domain compatibility and activity" Nature Biotechnology, 38(7):883-891 2020.
Schellenberger, V. et al. A recombinant polypeptide extends the in vivo half-life of peptides and proteins in a tunable manner. Nat Biotechnol 27, 1186-1190 (2009).
Stella, S., Alcón, P. & Montoya, G. Structure of the Cpf1 endonuclease R-loop complex after target DNA cleavage. Nature 546, 559-563 (2017).
Wollacott, A. M., Zanghellini, A., Murphy, P. & Baker, D. Prediction of structures of multidomain proteins from structures of the individual domains. Protein Sci 16, 165-175 (2007).
Zetsche, B. et al. Cpf1 Is a Single RNA-Guided Endonuclease of a Class 2 CRISPR-Cas System. Cell 163, 759-771 (2015).
Yamano, T. et al. Structural Basis for the Canonical and Non-canonical PAM Recognition by CRISPR-Cpf1. Mol Cell 67, (2017)., 633-645.
Mali, Prashant, et al., "RNA-Guided Human Genome Engineering via Cas9", Science, 339(6121), 2013, 823-826.

\* cited by examiner

FIG. 1A.
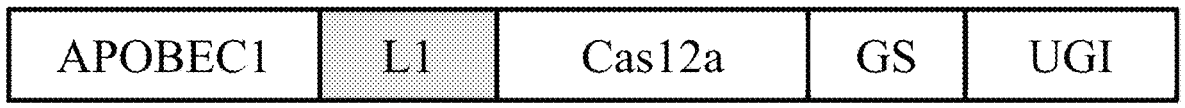
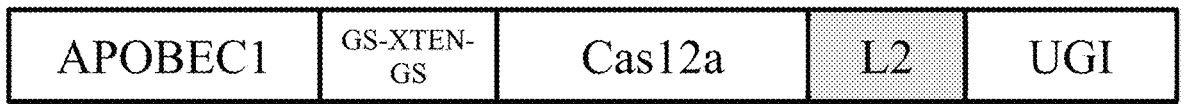
FIG. 1B.
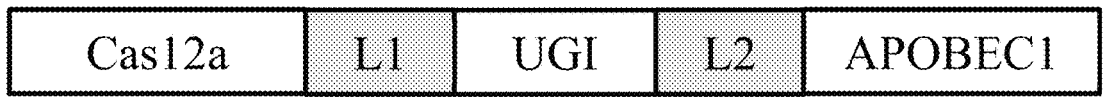
FIG. 1C.
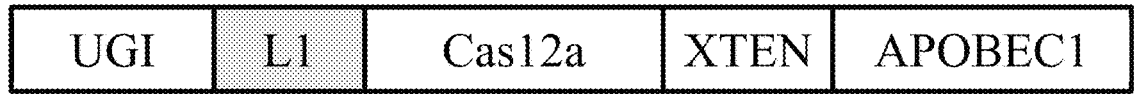
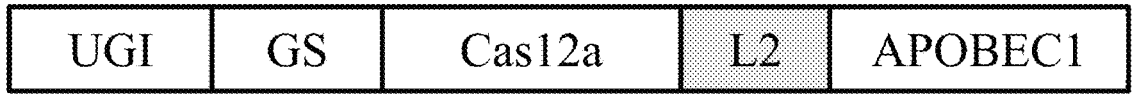

*FIG. 2*

| APOBEC1 | GS-XTEN-GS | Cas12a | GS | UGI |

| Cas12a | GS | UGI | GS | APOBEC1 |

OPTIMIZED PROTEIN LINKERS AND METHODS OF USE

STATEMENT OF PRIORITY

A Sequence Listing in ASCII text format, submitted under 37 C.F.R. § 1.821, entitled 1499-6CT ST25.txt, 727,798 bytes in size, generated on Aug. 2, 2021 and filed via EFS-Web, is provided in lieu of a paper copy. This Sequence Listing is hereby incorporated herein by reference into the specification for its disclosures.

STATEMENT REGARDING ELECTRONIC FILING OF A SEQUENCE LISTING

A Sequence Listing in ASCII text format, submitted under 37 C.F.R. § 1.821, entitled 1499-6_ST25.txt, 727,579 bytes in size, generated on Jun. 14, 2021 and filed via EFS-Web, is provided in lieu of a paper copy. This Sequence Listing is hereby incorporated herein by reference into the specification for its disclosures.

FIELD OF THE INVENTION

The invention relates to peptide linkers and fusion proteins comprising linkers designed for optimizing the activity of the proteins comprised therein, and methods for using the same. The invention further relates to newly designed Cas12a-based cytosine base editors.

BACKGROUND OF THE INVENTION

Over the past six years, CRISPR-based gene editing tools (particularly those based on Cas9) have become increasingly popular. While early tools relied on the ability of Cas9 to generate blunt-ended double strand breaks in DNA along with double-strand break repair mechanisms such as homologous recombination and non-homologous end joining, newer methods have been developed that use a modified version of the nuclease primarily as a targeting tool for other covalently linked effector proteins. Notably, the first Cas9-based base editors were developed by linking Cas9 to deaminase domains (see, e.g., Gaudelli et al. *Nature* 551: 464-471 (2017)). The initial cytosine base editor was built by linking a rat APOBEC1 domain (Apolipoprotein B mRNA editing enzyme), which deaminates cytosine to uracil in both RNA and DNA, to the N terminus of Cas9 using a linker based on the previously published unstructured XTEN protein (Komor et al. *Nature* 533(7603): 420-424 (2016). A uracil DNA glycosylase inhibitor (UGI) domain was linked to the C terminus of Cas9 to reduce base excision repair activity. Later versions of the Cas9 cytosine base editors (CBE) doubled the lengths of both linkers by adding flexible glycine and serine residues and added an additional UGI domain. The most recent version of this base editor has been optimized for use in human cells by codon optimization and improved nuclear localization signals, and ancestral reconstruction of the deaminase domain.

Cas12a, also known as Cpf1, is a more recently discovered CRISPR endonuclease that has also been used increasingly as a genome editing tool. Cas12a differs from Cas9 in several respects, including, for example, its size, its nuclease activities, the structure of the guide RNA, the orientation in which the nuclease binds its guide RNA, and the protospacer adjacent motifs (PAMs) that are recognized. Although some variations of Cas12a-based cytosine base editors have been tested, they have lower activity compared to Cas9-based versions. Thus, to overcome the short comings in the art, new adenosine base editing tools using Cas12a are needed.

SUMMARY OF THE INVENTION

The current state of the art CRISPR-based cytosine base editors are heavily based on Cas9, and published versions of Cas12a-based cytosine base editors are relatively inefficient compared to Cas9-based versions. Part of this deficiency is likely due to the different architecture and binding orientation of Cas12a compared to Cas9. Cas9-based cytosine base editors rely on simple GS linkers or previously designed unstructured sequences, and their lengths and compositions have not been designed for optimal placement of the deaminase and UGI domains relative to the edited DNA. Moreover, Cas12a-derived base editors have not reached a level of activity suitable for commercial applications. The present inventors have designed novel linker sequences and optimized the domain architectures for Cas12a-based cytosine base editors, which now may allow for targeting of new sites and/or expanding the repertoire of site-specific base editing tools and/or which may be appropriate for commercial use. Also provided are methods of modifying nucleic acids using a fusion protein of the invention and/or a polynucleotide encoding the same. These editors can be used for prokaryotic and/or eukaryotic applications including editing genomes of commercially-relevant crops.

One aspect of the invention provides a polypeptide comprising any one of the amino acid sequences of SEQ ID NOs: 1-24 (L1-L24).

A second aspect of the invention provides a polypeptide comprising a Cas12a domain and any one of the amino acid sequences of SEQ ID NOs: 1-24.

A third aspect provides a fusion protein comprising a Cas12a domain, a polypeptide of interest, and any one of the amino acid sequences of SEQ ID NOs: 1-24.

A fourth aspect provides a Type V Clustered Regularly Interspaced Short Palindromic Repeats (CRISPR) associated (Cas) (CRISPR-Cas) system comprising: (a) a fusion protein comprising a Cas12a domain, a linker comprising an amino acid sequence of any one of SEQ ID NOs:1-24, and a polypeptide of interest; wherein the Cas12a domain is linked to the polypeptide of interest via any one of the amino acid sequences of SEQ ID NOs: 1-24, or a nucleic acid encoding the fusion protein; and (b) a guide nucleic acid (CRISPR RNA, CRISPR DNA, crRNA, crDNA, gRNA) comprising a spacer sequence and a repeat sequence, wherein the guide nucleic acid is capable of forming a complex with the Cas12a domain of the fusion protein and the spacer sequence is capable of hybridizing to a target nucleic acid, thereby guiding the Cas12a domain and the polypeptide of interest to the target nucleic acid, whereby the system is capable of modifying or modulating the target nucleic acid.

A fifth aspect of the invention provides a fusion protein comprising: (a) a Cas12a domain, wherein the Cas12a domain, when in conjunction with a bound guide nucleic acid (e.g., gRNA), specifically binds to a target nucleic acid sequence; (b) a cytidine deaminase domain, wherein the cytidine deaminase domain deaminates a cytosine base in a single-stranded portion of the target nucleic acid sequence when in conjunction with the Cas12a domain and the gRNA; and (c) a uracil glycosylase inhibitor (UGI) domain, wherein the UGI domain inhibits a uracil-DNA glycosylase, wherein the Cas12a domain is linked to the cytosine deaminase domain or the UGI domain via any one of the amino acid sequence of SEQ ID NOs:1-24.

A sixth aspect provides a fusion protein comprising, (a) a cytosine deaminase domain; (b) a Cas12a domain; and (c) a uracil DNA glycosylase inhibitor (UGI) domain, wherein the C-terminus of the cytosine deaminase domain is linked to the N-terminus of the Cas12a domain via any one of the amino acid sequences of SEQ ID NOs:1-5 and the C-terminus of the Cas12a domain is linked to the N-terminus of the UGI domain, or the C-terminus of the Cas12a domain is linked to the N-terminus of the UGI domain via any one of the amino acid sequences of SEQ ID NOs:6-9 and the C-terminus of the cytosine deaminase domain is linked to the N-terminus of the Cas12a domain.

A seventh aspect provides a fusion protein comprising, (a) a Cas12a (Cpf1) domain; (b) a uracil DNA glycosylase inhibitor (UGI) domain; and (c) a cytosine deaminase domain, wherein the C-terminus of the Cas12a domain is linked to the N-terminus of the UGI domain via any one of the amino acid sequences of SEQ ID NOs:10-12 and the C-terminus of the UGI domain is linked to the N-terminus of the cytosine deaminase domain via any one of the amino acid sequences of SEQ ID NOs:13-16, wherein the amino acid sequences of SEQ ID NOs:10-12 and the amino acid sequences of SEQ ID NOs:13-16 are independently selected.

An eighth aspect provides a fusion protein comprising, (a) a uracil DNA glycosylase inhibitor (UGI) domain; (b) a Cas12a (Cpf1) domain, wherein the Cas12a domain comprises a mutation in the nuclease active site; and (c) a cytosine deaminase domain, wherein the C-terminus of the UGI domain is linked to the N-terminus of the Cas12a domain via any one of the amino acid sequences of SEQ ID NOs:17-19 and the C-terminus of the Cas12a domain is linked to the N-terminus of the cytosine deaminase domain, or wherein the C-terminus of the UGI domain is linked to the N-terminus of the Cas12a domain and the C-terminus of the Cas12a domain is linked to the N-terminus of the cytosine deaminase domain via any one of the amino acid sequences of SEQ ID NOs:20-24.

A ninth aspect of the invention provides a method of modifying a target nucleic acid, the method comprising contacting the target nucleic acid with: (a)(i) a fusion protein of the invention, and (a)(ii) a guide nucleic acid; (b) a complex comprising a fusion protein of the invention and a guide nucleic acid; (c) a composition comprising a fusion protein of the invention and a guide nucleic acid; and/or (d) a system of the invention, thereby modifying a target nucleic acid.

A tenth aspect of the invention provides a method of modifying a target nucleic acid, the method comprising contacting a cell or a cell free system comprising the target nucleic acid with: (a)(i) a polynucleotide encoding a polypeptide or fusion protein of the invention, or an expression cassette or vector comprising the same, and (a)(ii) a guide nucleic acid, or an expression cassette or vector comprising the same; and/or (b) a nucleic acid construct encoding a complex comprising a fusion protein of the invention and a guide nucleic acid, or an expression cassette or vector comprising the same under conditions wherein when the fusion protein is expressed and forms a complex with the guide nucleic acid, the complex hybridizes to the target nucleic acid, thereby modifying a target nucleic acid.

An eleventh aspect of the invention provides a method of editing a target nucleic acid, the method comprising contacting the target nucleic acid with: (a)(i) a fusion protein of the invention, and (a)(ii) a guide nucleic acid; (b) a complex comprising a fusion protein of the invention and a guide nucleic acid; (c) a composition comprising (i) a fusion protein of the invention and (ii) a guide nucleic acid; and/or (d)(i) a system of the invention, wherein the cytosine deaminase domain converts a cytosine (C) to a thiamine (T) in the target nucleic acid, thereby editing the target nucleic acid to produce a (point) mutation.

A twelfth aspect of the invention provides a method of editing a target nucleic acid, the method comprising contacting a cell or a cell free system comprising the target nucleic acid with: (a)(i) a polynucleotide encoding a fusion protein of the invention, or an expression cassette or vector comprising the same, and (a)(ii) a guide nucleic acid, or an expression cassette or vector comprising the same; and/or (b) a nucleic acid construct encoding a complex comprising a fusion protein of the invention and a guide nucleic acid, or an expression cassette or vector comprising the same under conditions wherein when the fusion protein is expressed and forms a complex with the guide nucleic acid, the complex hybridizes to the target nucleic acid, wherein the cytosine deaminase domain converts a cytosine (C) to a thiamine (T) in the target nucleic acid, thereby editing the target nucleic acid to produce a (point) mutation.

The invention further provides constructs, complexes, compositions, expression cassettes, vectors and cells comprising polypeptides and/or fusion proteins of the invention and/or polynucleotides and nucleic acid constructs encoding the fusion proteins and complexes of the invention.

These and other aspects of the invention are set forth in more detail in the description of the invention below.

BRIEF DESCRIPTION OF THE SEQUENCES

SEQ ID NOs:1-24 are the amino acid sequences of the invention useful for linking polypeptides.

SEQ ID NOs:25-28 are amino acid sequences for exemplary peptide linkers useful for linking polypeptides.

SEQ ID NOs:29-45 are example Cas12a amino acid sequences useful with this invention.

SEQ ID NOs:46-47 and SEQ ID NOs:76-82 are example cytosine deaminase amino acid sequences useful with this invention.

SEQ ID NOs:48 is an exemplary uracil-DNA glycosylase inhibitor (UGI).

SEQ ID NOs:49-72 and SEQ ID NOs:91-107 are example fusion proteins.

SEQ ID NOs:83-88 are example spacer sequences.

SEQ ID NO:89 and SEQ ID NO:90 are example intron sequences, human and soybean, respectively.

BRIEF DESCRIPTION OF THE DRAWINGS

FIGS. 1A-C provides exemplary domain arrangements of Cas12a-based cytosine base editors of the invention selected for experimental screening in mammalian cells. For the constructs in FIG. 1A (ACU) and FIG. 1C (UCA), each linker to APOBEC1 or UGI was tested independently and paired with a control linker (either the 8-residue GS linker, the XTEN linker, or the GS-XTEN-GS linker). For the constructs in FIG. 1B (CUA), all combinations of linkers were tested.

FIG. 2 provides two Cas12a cytosine base editor designs used as controls.

DETAILED DESCRIPTION

Figure 3:
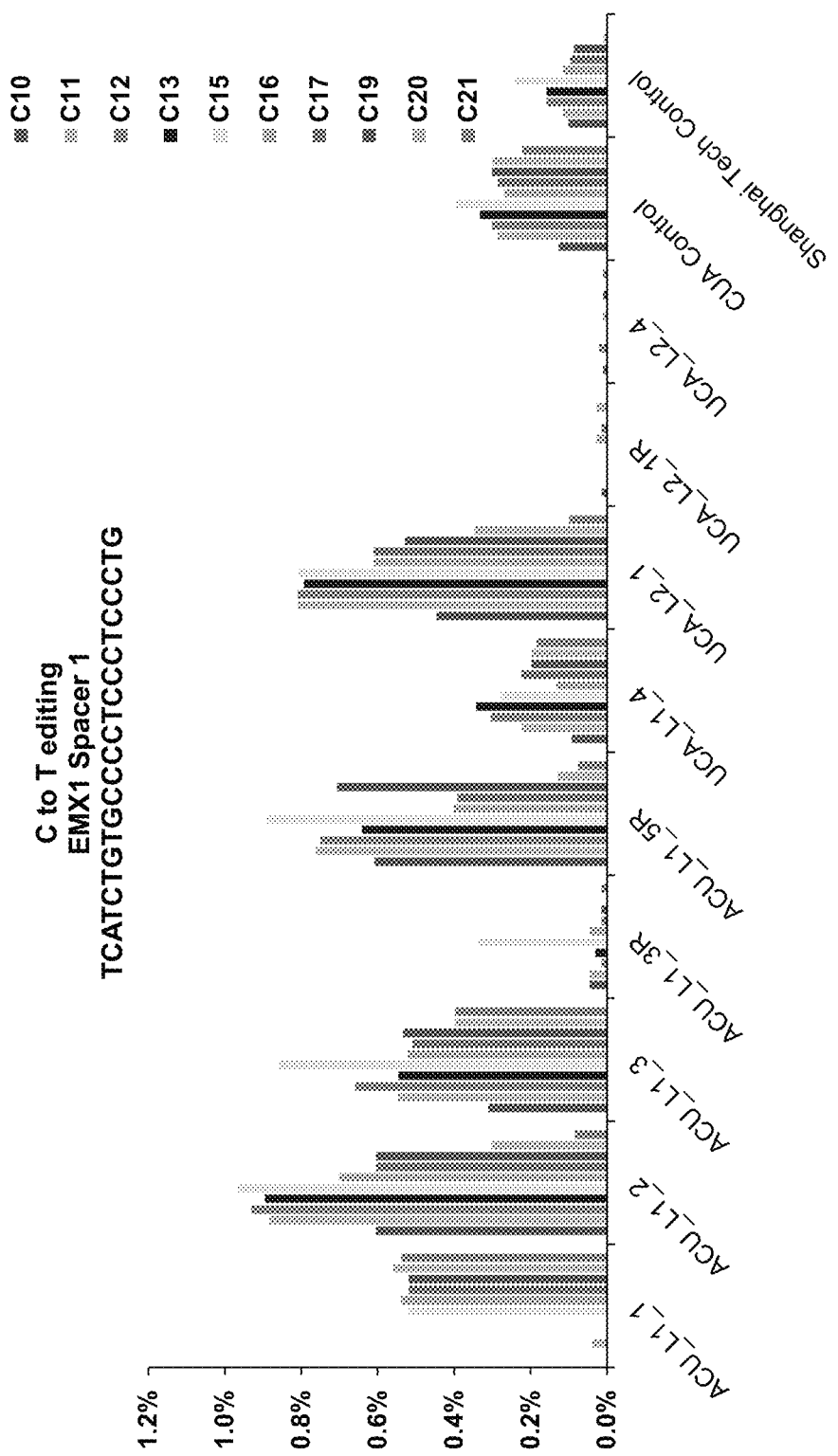
FIG. 3 shows the results of C to T editing using EMX1 spacer 1: TCATCTGTGCCCCTCCCTCCCTG (SEQ ID NO:83). The Y axis indicates the level of C→T editing observed for a given cytosine at the specified position within the spacer.
Figure 4:
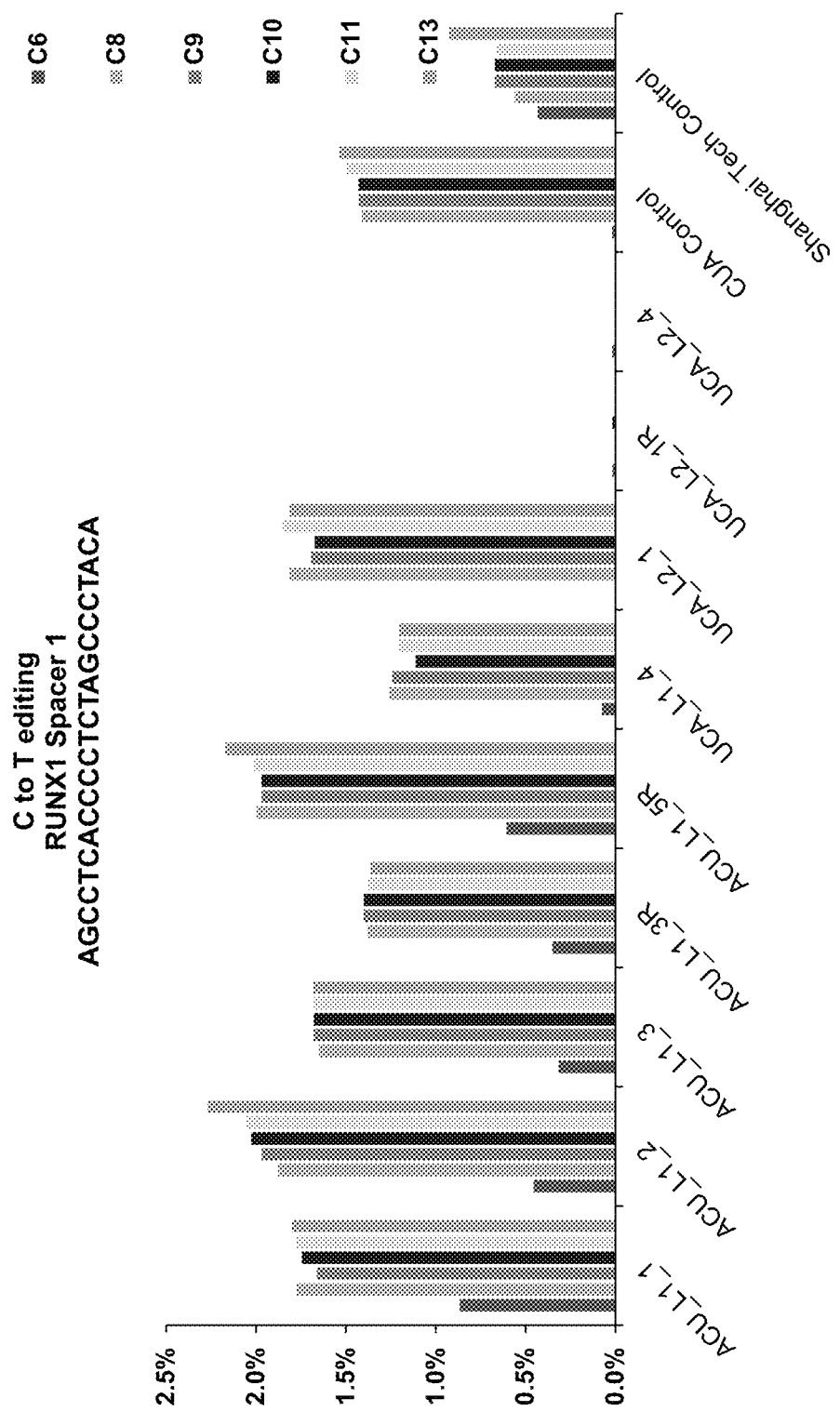
FIG. 4 shows the results of C to T editing using RUNX1 spacer 1: AGCCTCACCCCTCTAGCCCTACA (SEQ ID NO:84). The Y axis indicates the level of C→T editing observed for a given cytosine at the specified position within the spacer.
Figure 5:
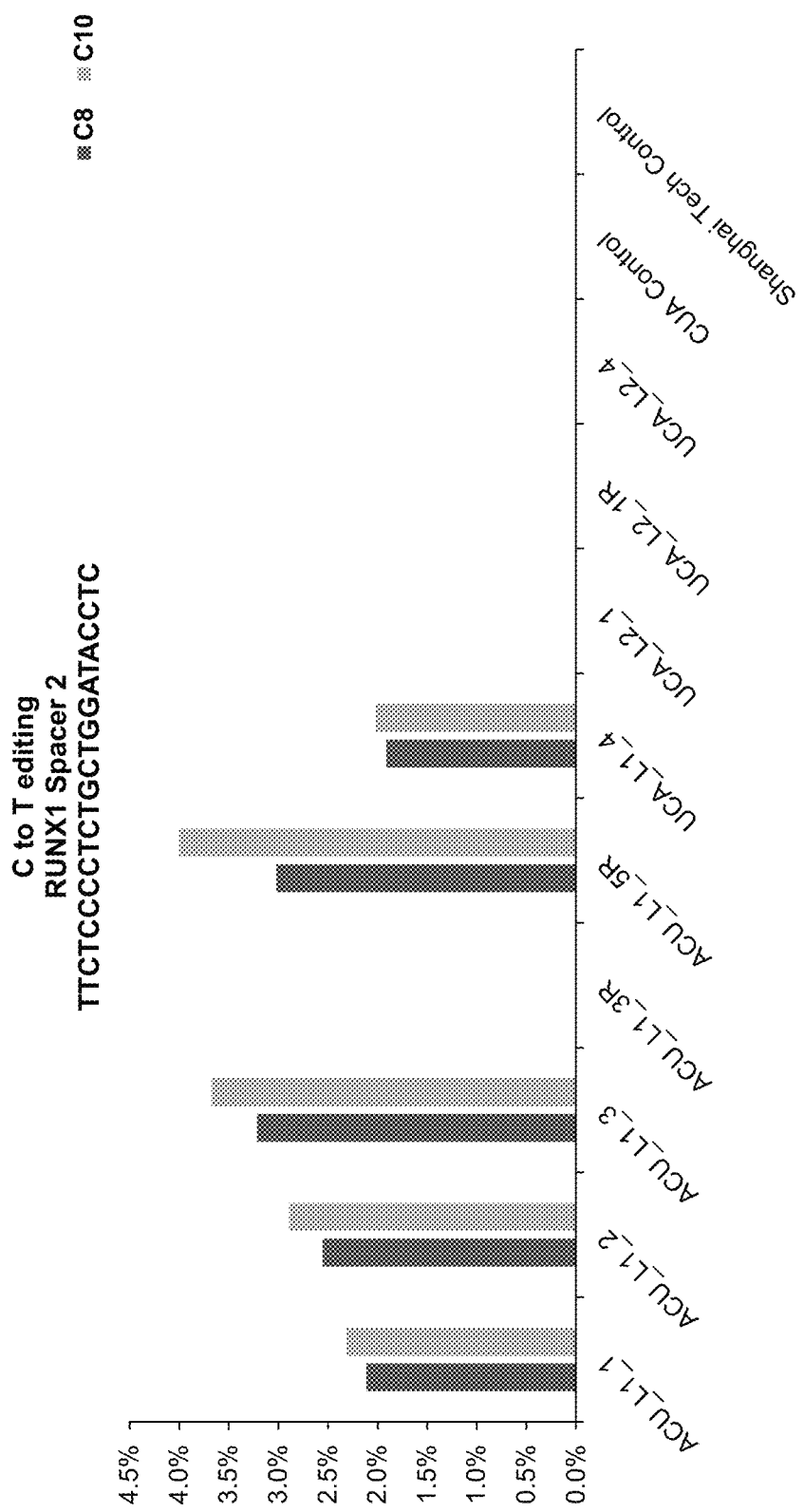
FIG. 5 shows the results of C to T editing using RUNX1 spacer 2: TTCTCCCCTCTGCTGGATACCTC (SEQ ID NO:85). The Y axis indicates the level of C→T editing observed for a given cytosine at the specified position within the spacer. No editing data is available for constructs UCA_L2_1, UCA_L2_1R, UCA_L2-4, CUA control or Shanghai Tech control.
Figure 6:
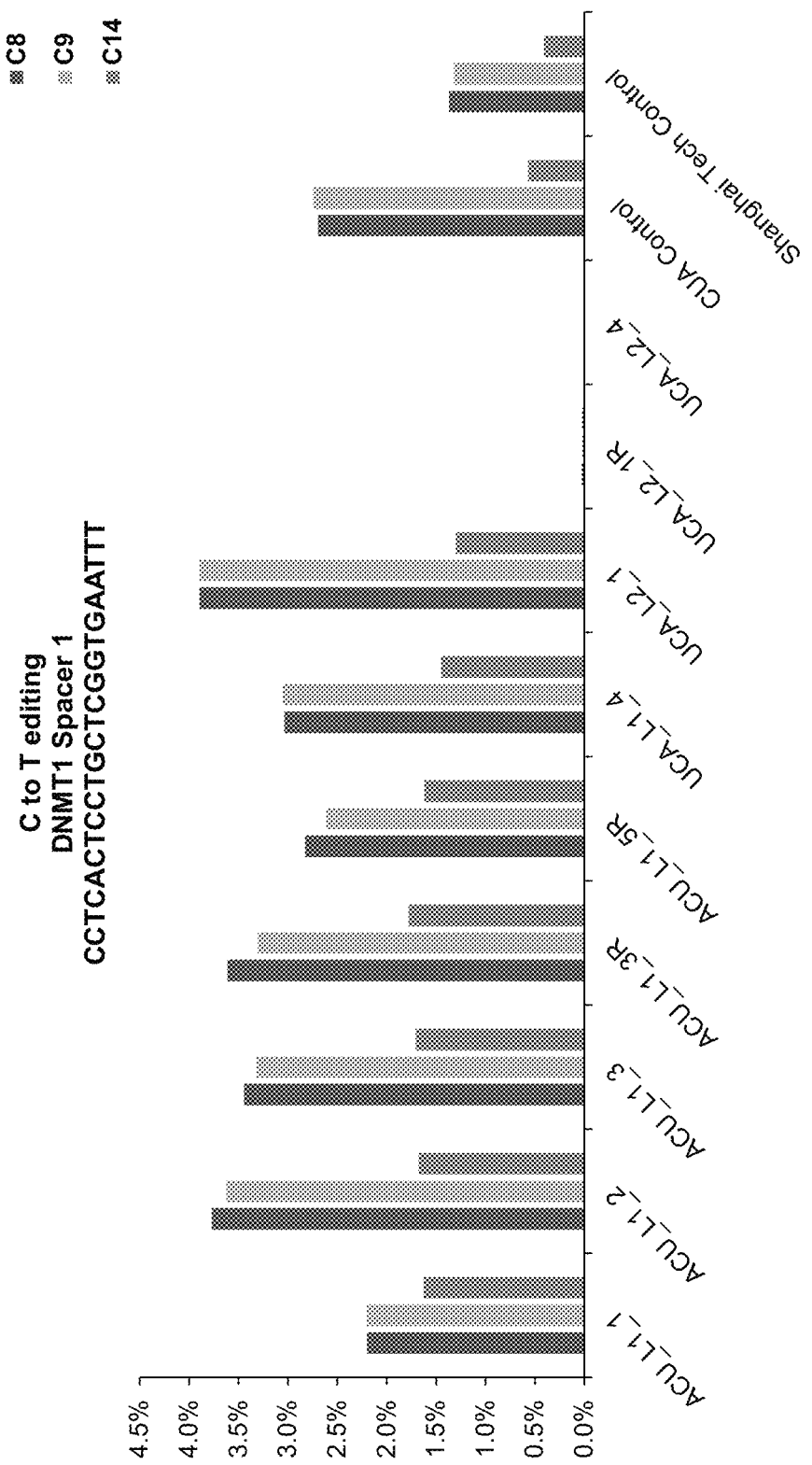
FIG. 6 shows the results of C to T editing using DNMT1 spacer 1: CCTCACTCCTGCTCGGTGAATTT (SEQ ID NO:86). The Y axis indicates the level of C→T editing observed for a given cytosine at the specified position within the spacer.
Figure 7:
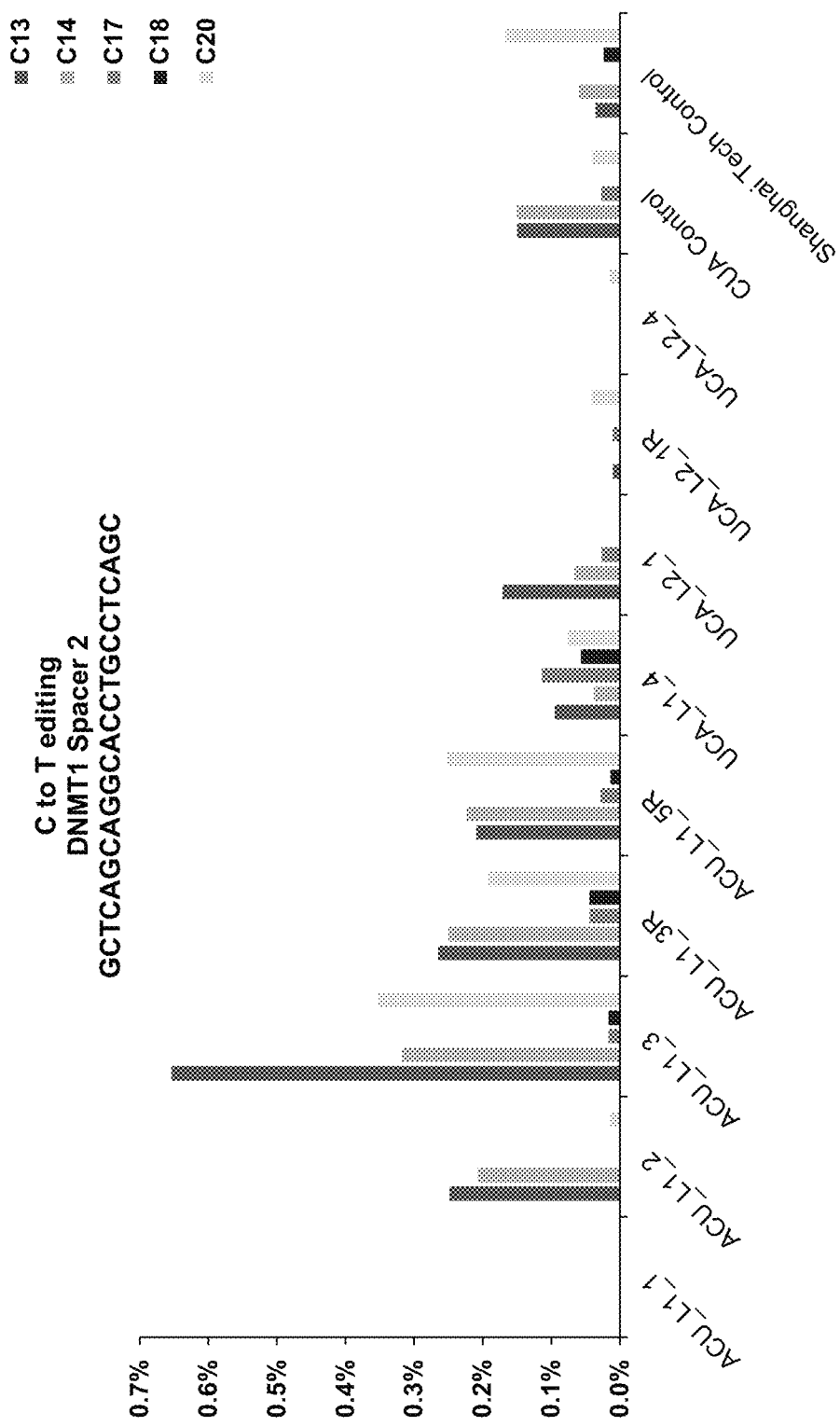
FIG. 7 shows the results of C to T editing using DNMT1 spacer 2: GCTCAGCAGGCACCTGCCTCAGC (SEQ ID NO:87). The Y axis indicates the level of C→T editing observed for a given cytosine at the specified position within the spacer. No editing data is available for construct ACU_L1_1.
Figure 8:
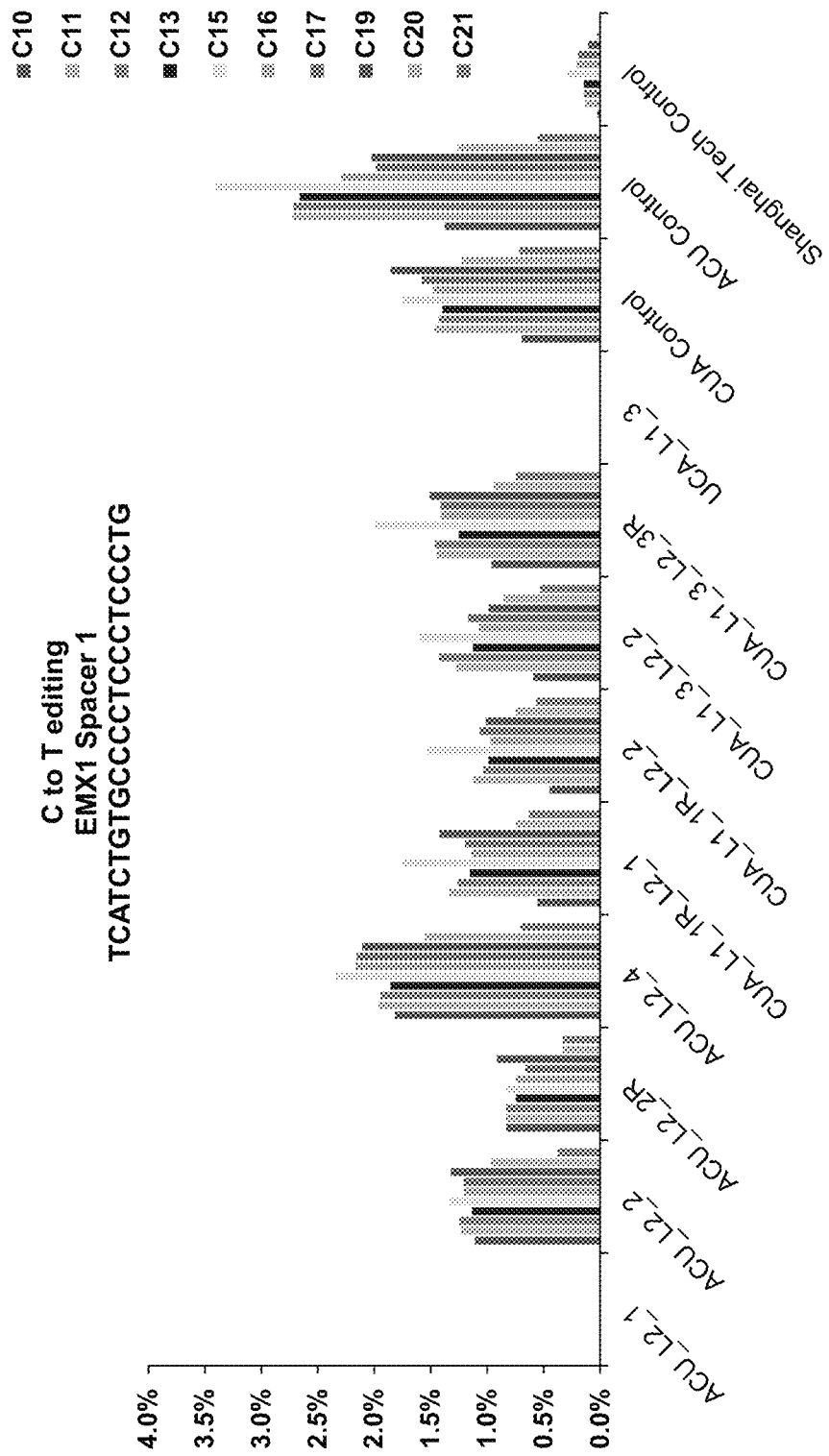
FIG. 8 shows the results of C to T editing using EMX1 spacer 1: TCATCTGTGCCCCTCCCTCCCTG (SEQ ID NO:83). The Y axis indicates the level of C→T editing observed for a given cytosine at the specified position within the spacer.
Figure 9:
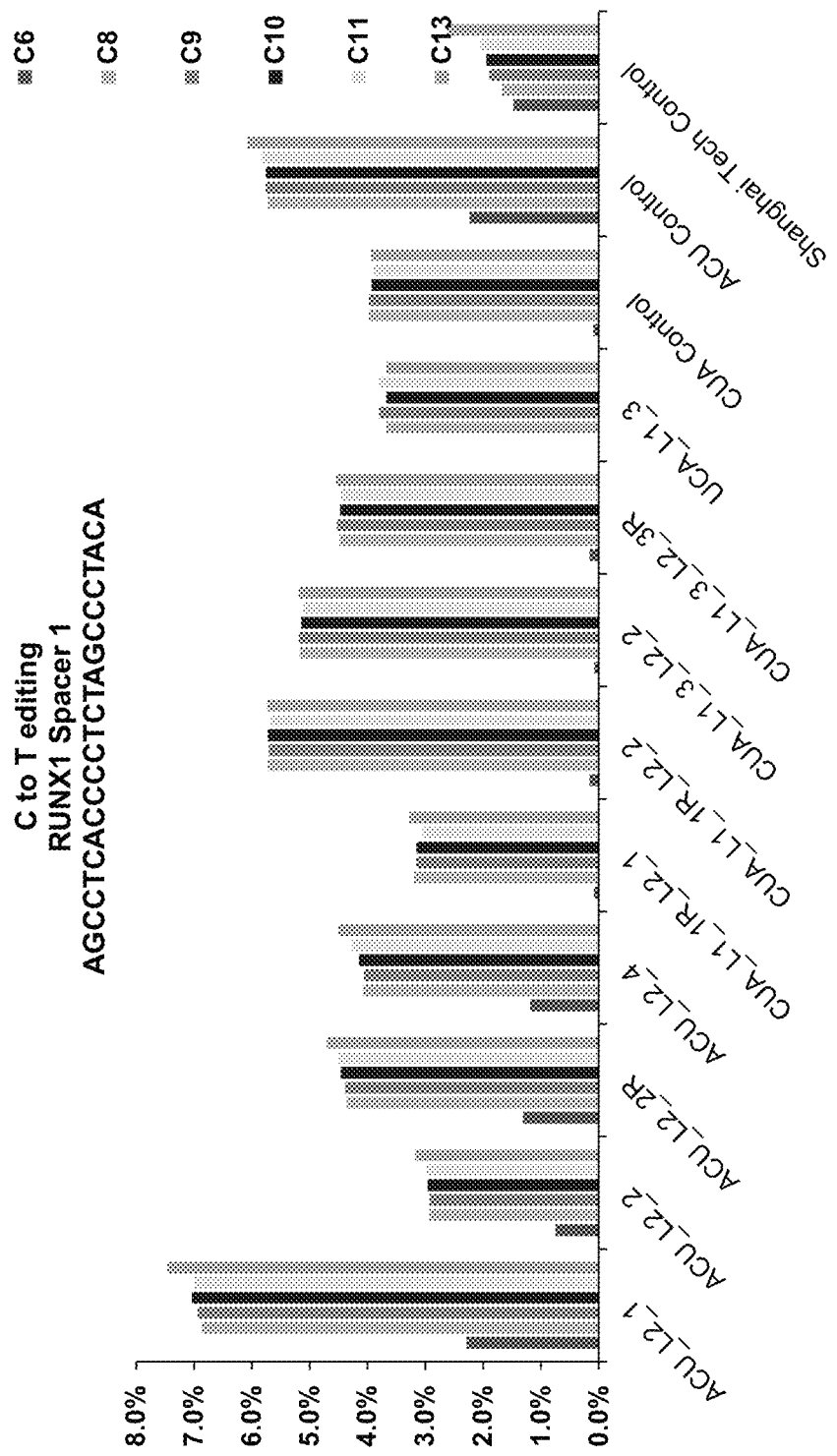
FIG. 9 shows the results of C to T editing using RUNX1 spacer 1: AGCCTCACCCCTCTAGCCCTACA (SEQ ID NO:84).
Figure 10:
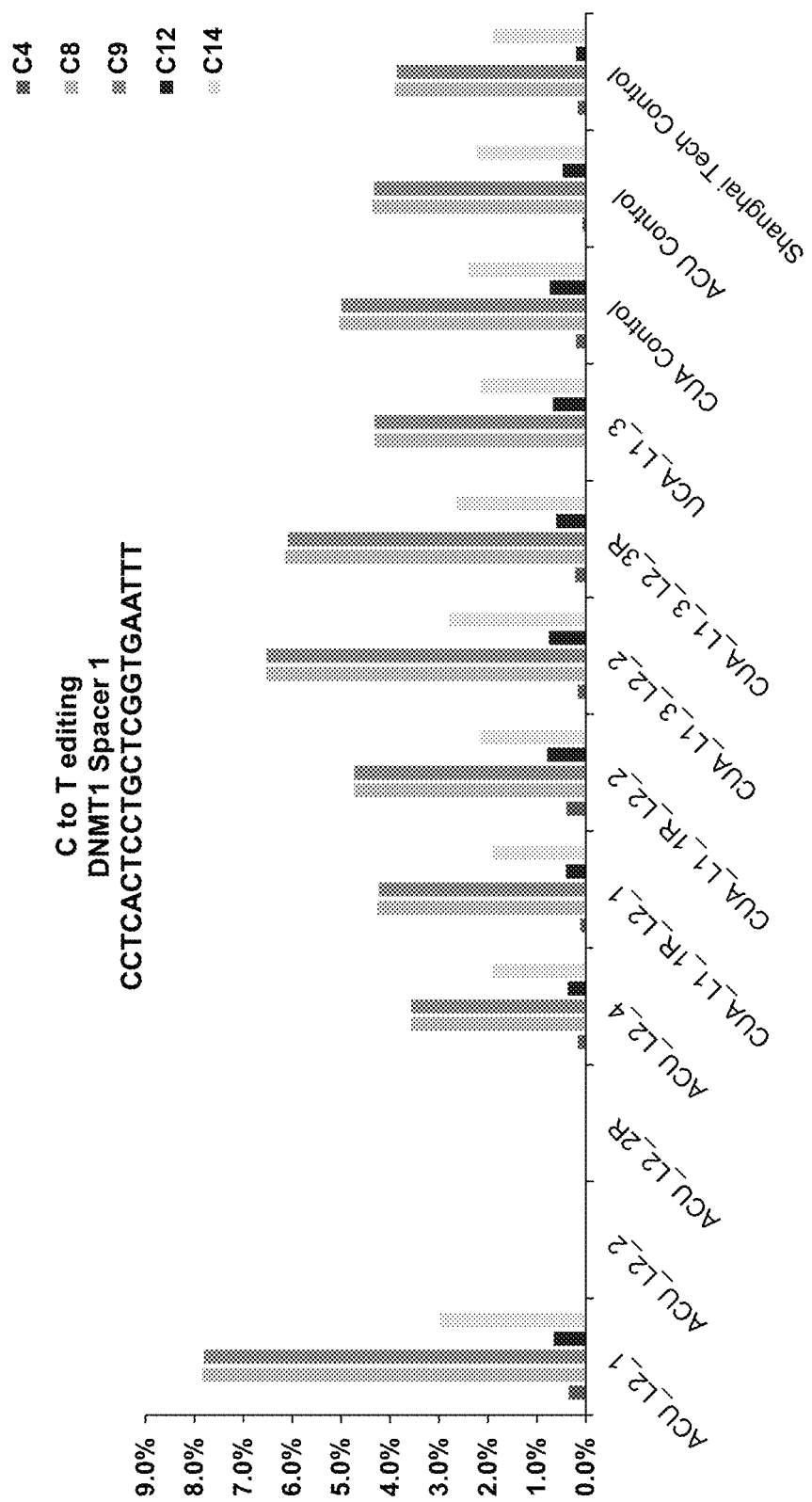
FIG. 10 shows the results of C to T editing using DNMT1 spacer 1: CCTCACTCCTGCTCGGTGAATTT (SEQ ID NO:86). The Y axis indicates the level of C→T editing observed for a given cytosine at the specified position within the spacer. No editing data is available for constructs ACU_L1_2, ACU_L2_2R.
Figure 11:
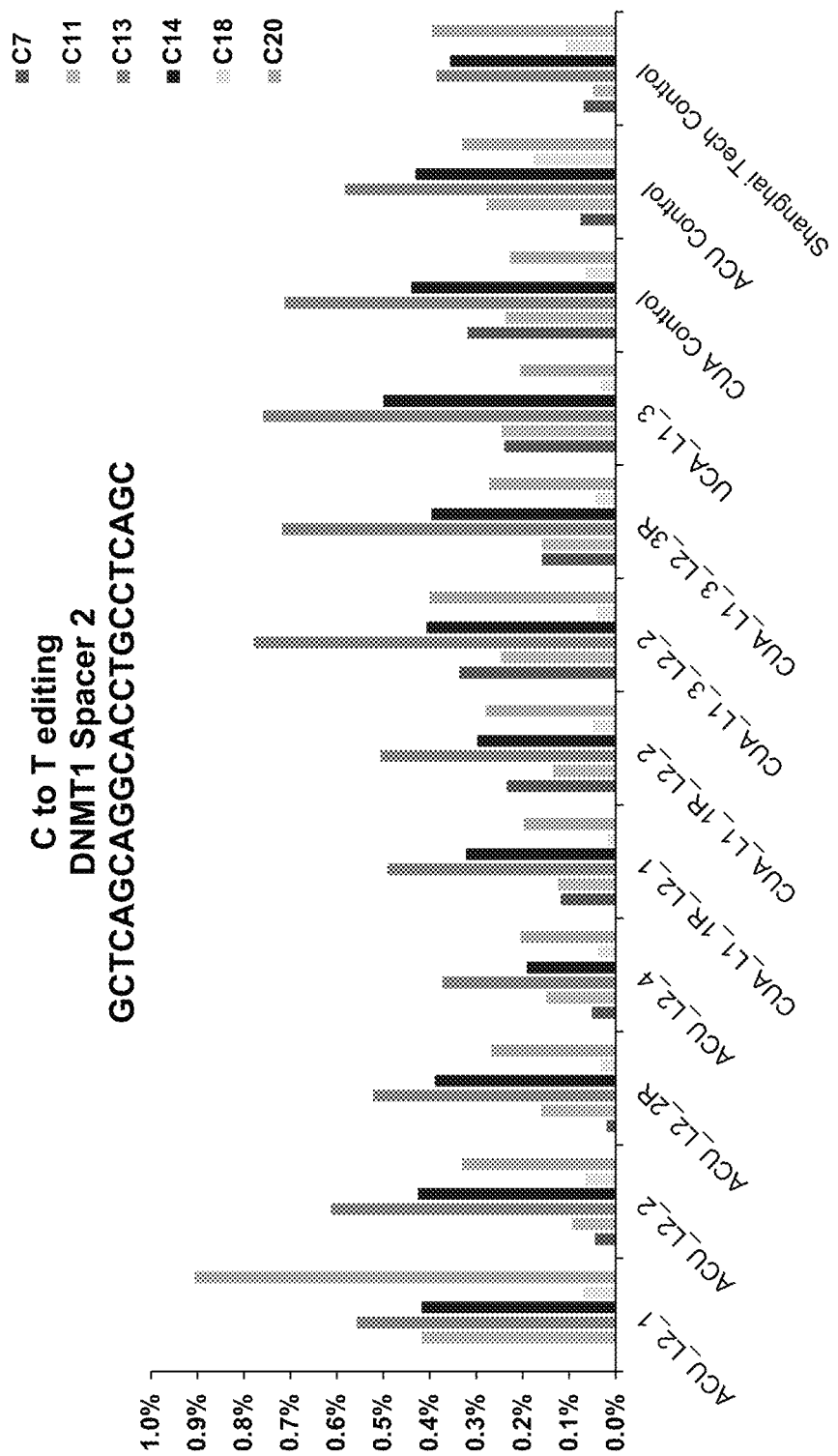
FIG. 11 shows the results of C to T editing using DNMT1 spacer 2: GCTCAGCAGGCACCTGCCTCAGC(SEQ ID NO:87). The Y axis indicates the level of C→T editing observed for a given cytosine at the specified position within the spacer
Figure 12:
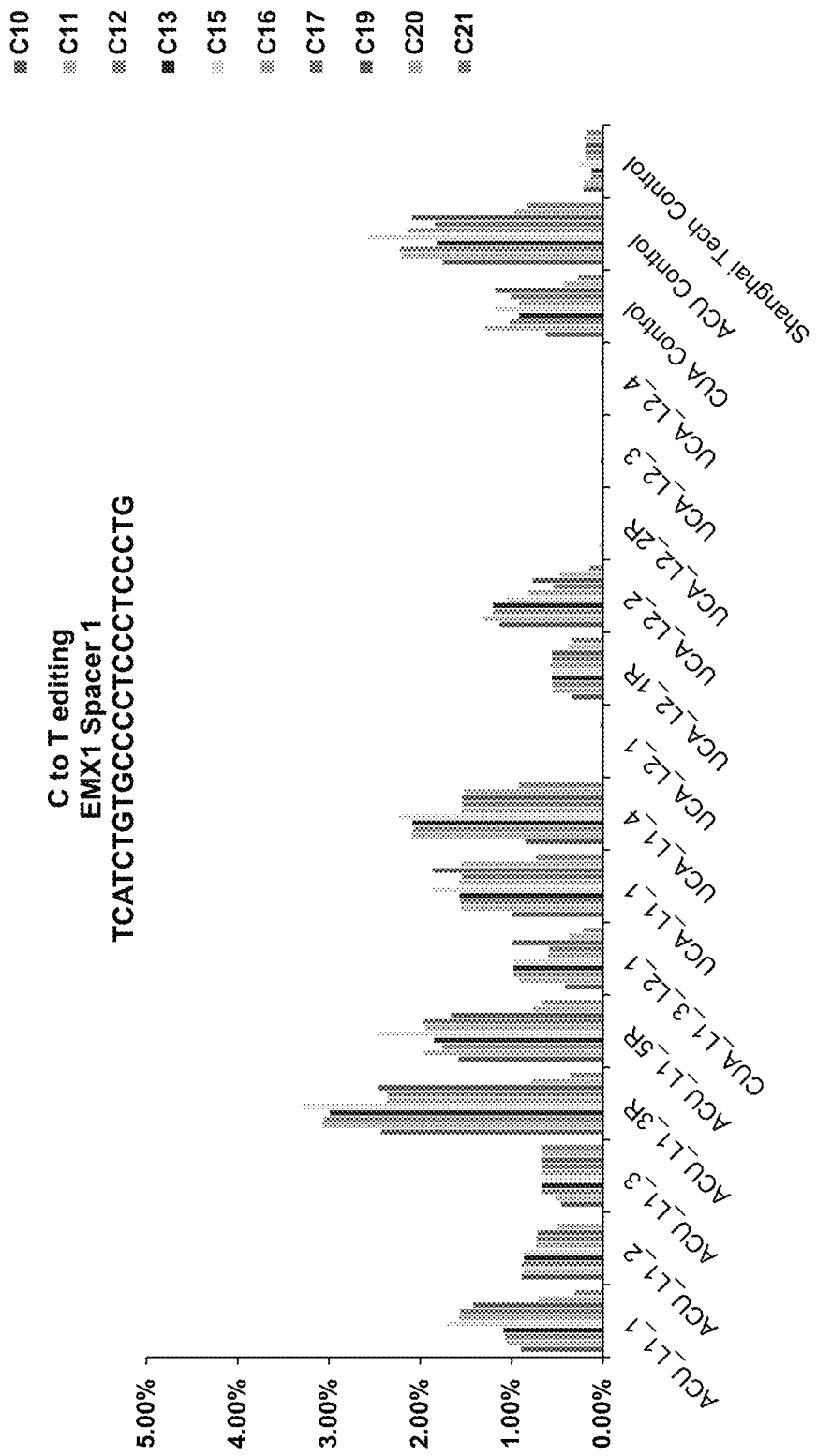
FIG. 12 shows the results of C to T editing using EMX1 spacer 1: TCATCTGTGCCCCTCCCTCCCTG (SEQ ID NO:83). The Y axis indicates the level of C→T editing observed for a given cytosine at the specified position within the spacer.
Figure 13:
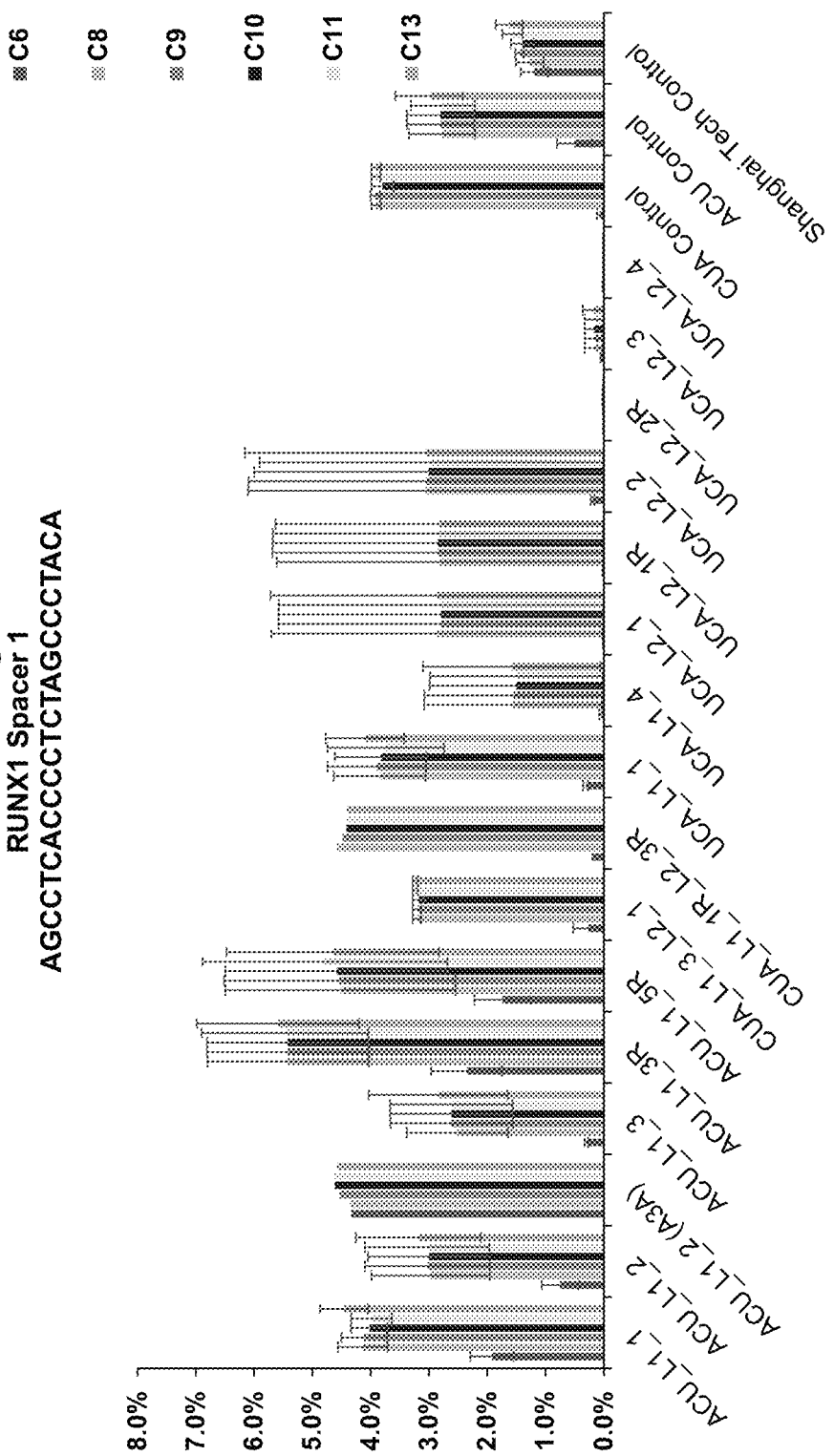
FIG. 13 shows the results of C to T editing using RUNX1 spacer 1: AGCCTCACCCCTCTAGCCCTACA (SEQ ID NO:84). The Y axis indicates the level of C→T editing observed for a given cytosine at the specified position within the spacer.
Figure 14:
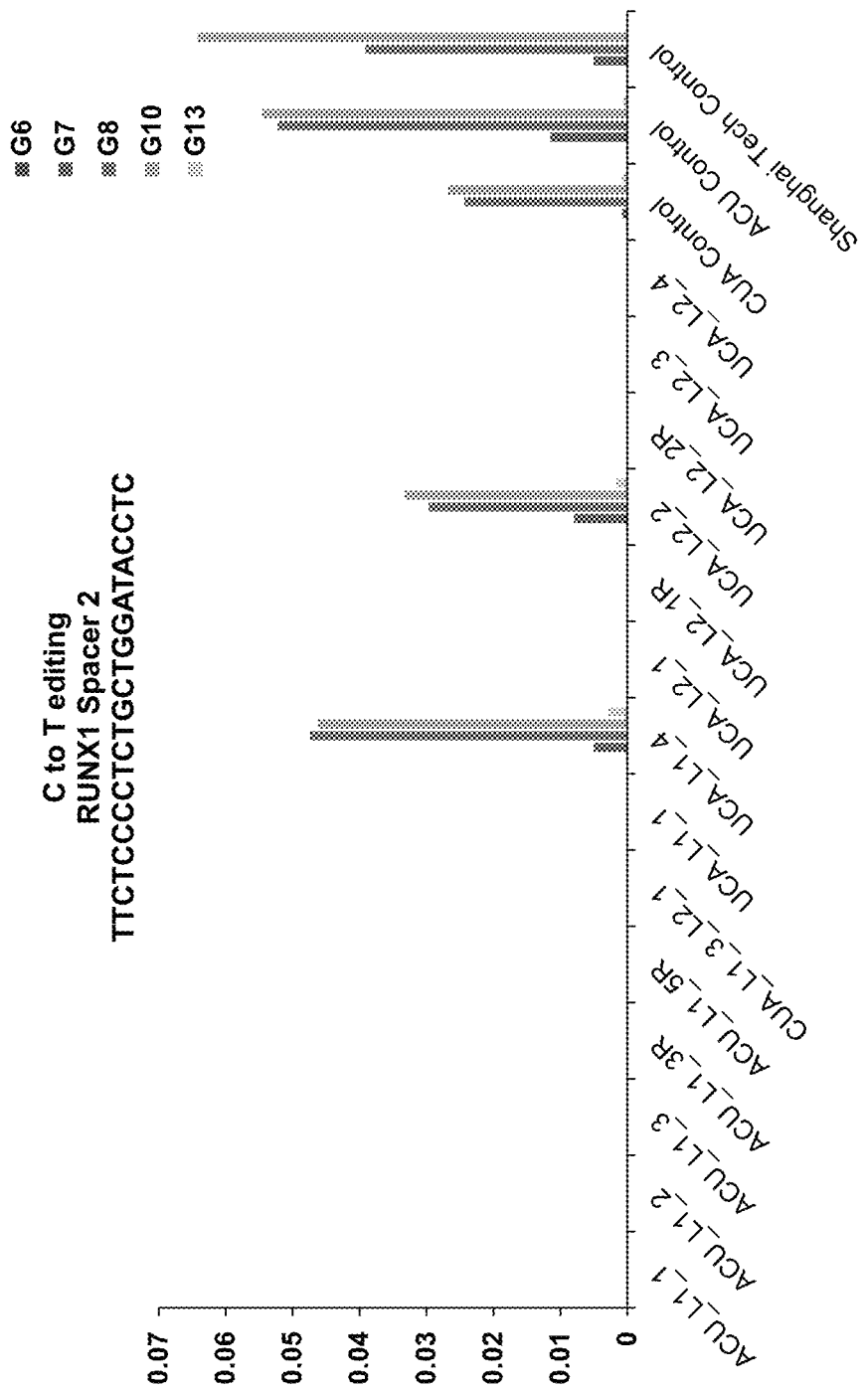
FIG. 14 shows the results of C to T editing using RUNX1 spacer 2: TTCTCCCCTCTGCTGGATACCTC (SEQ ID NO:85). The Y axis indicates the level of C→T editing observed for a given cytosine at the specified position within the spacer. No editing data is available for constructs ACU_L1_1, ACU_L1_2, ACU_L1_3, ACU_L1_3R, ACU_L1_5R, CUA_L1_3_L2_1, UCA_L1_1, UCA_L2_1, UCA_L2_1R, and UCA_L2_4).
Figure 15:
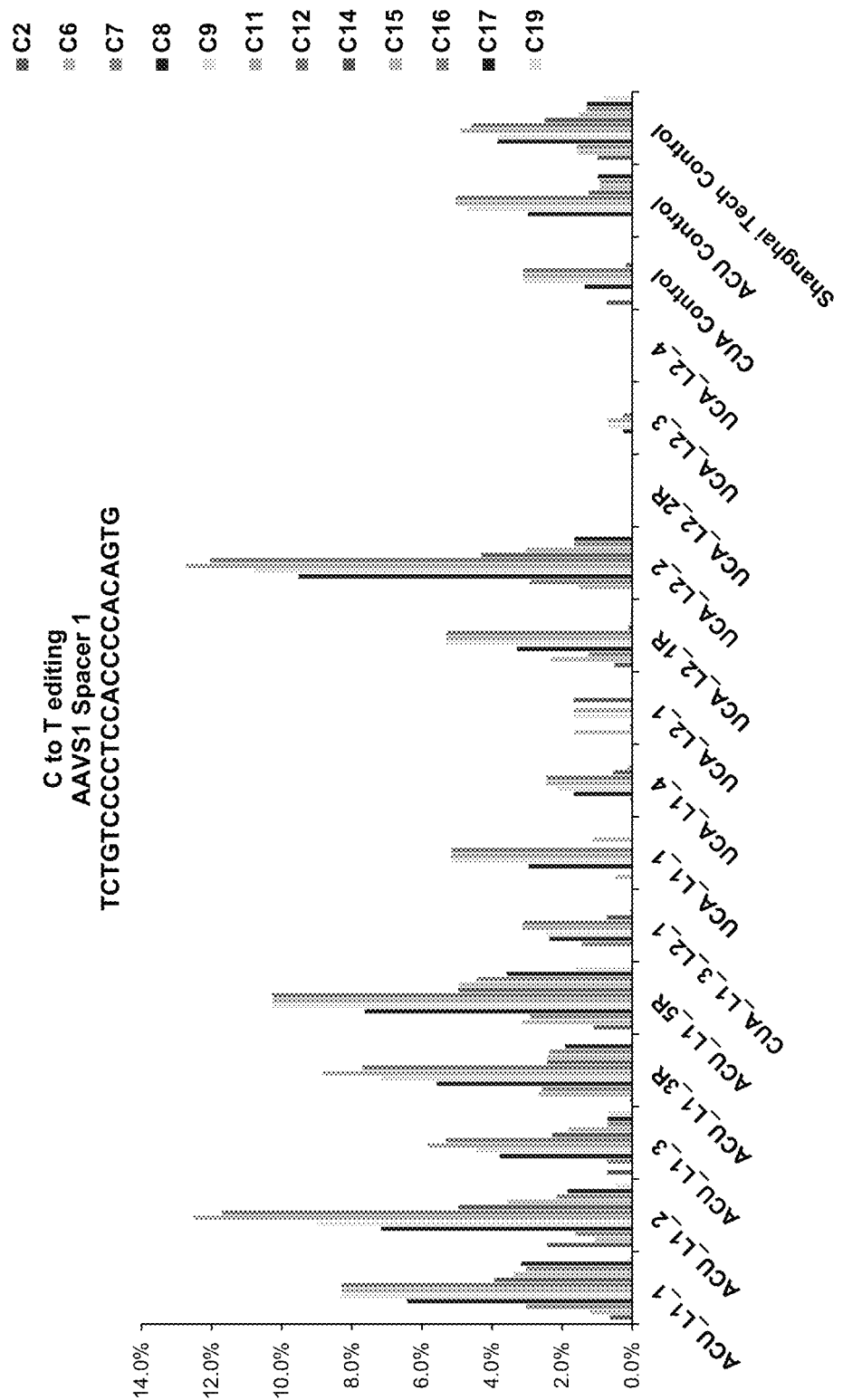
FIG. 15 shows the results of C to T editing using AAVS1 spacer 1: TCTGTCCCCTCCACCCCACAGTG (SEQ ID NO:88). The Y axis indicates the level of C→T editing observed for a given cytosine at the specified position within the spacer.
Figure 16:
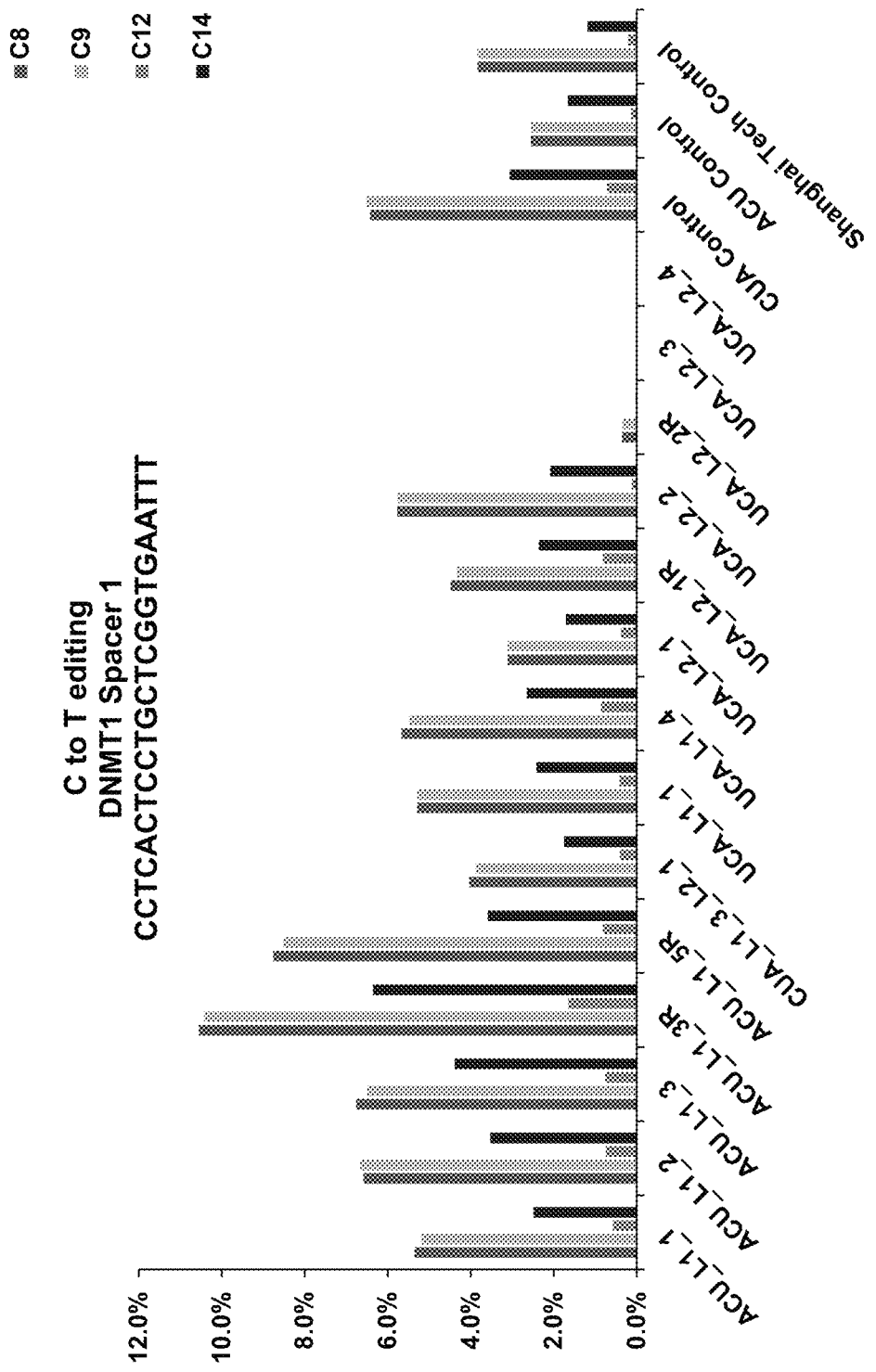
FIG. 16 shows the results of C to T editing using DNMT1 spacer 1: CCTCACTCCTGCTCGGTGAATTT (SEQ ID NO:86). The Y axis indicates the level of C→T editing observed for a given cytosine at the specified position within the spacer.
Figure 17:
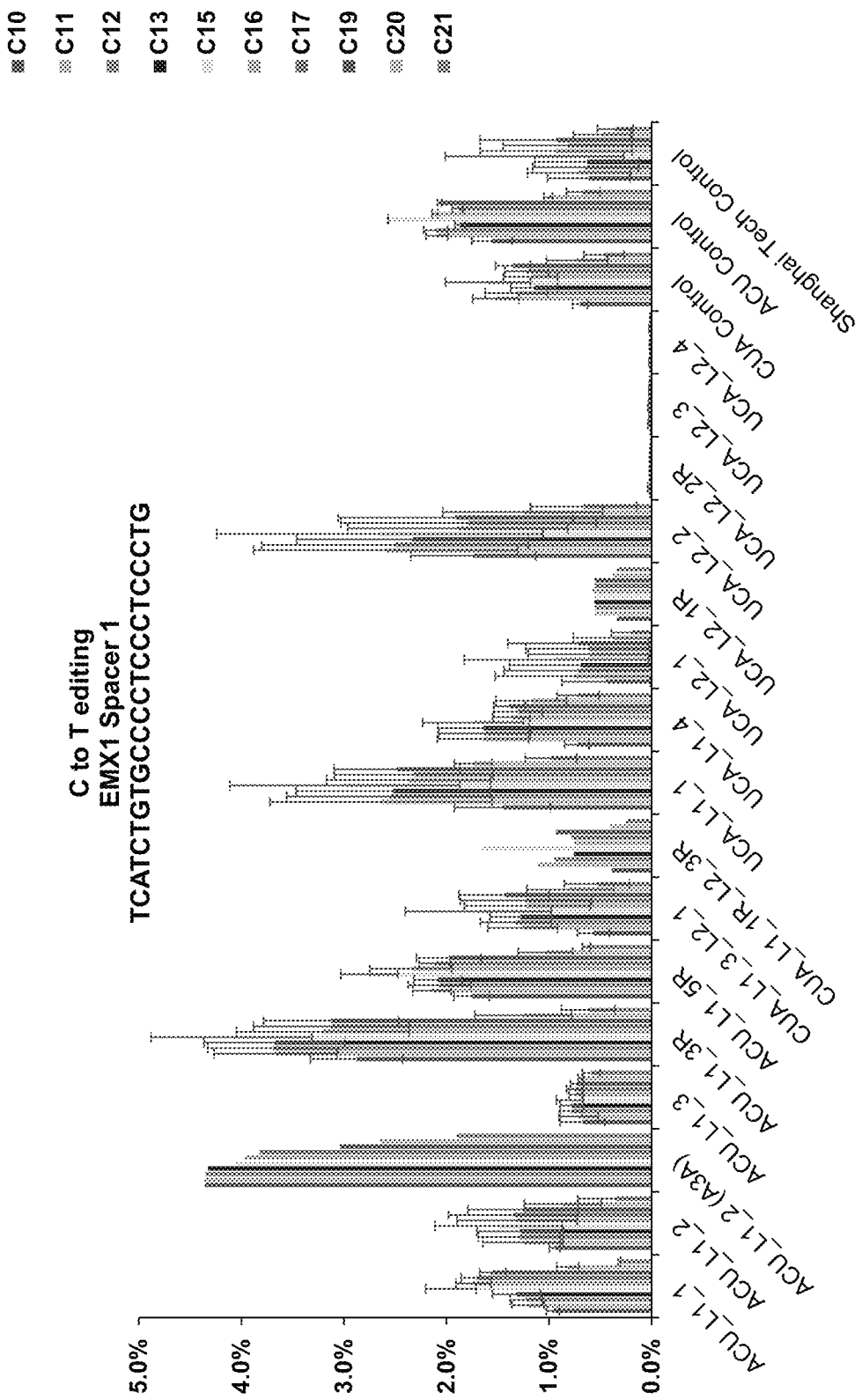
FIG. 17 shows the results of C to T editing using EMX1 spacer 1: TCATCTGTGCCCCTCCCTCCCTG (SEQ ID NO:83). The Y axis indicates the level of C→T editing observed for a given cytosine at the specified position within the spacer.
Figure 18:
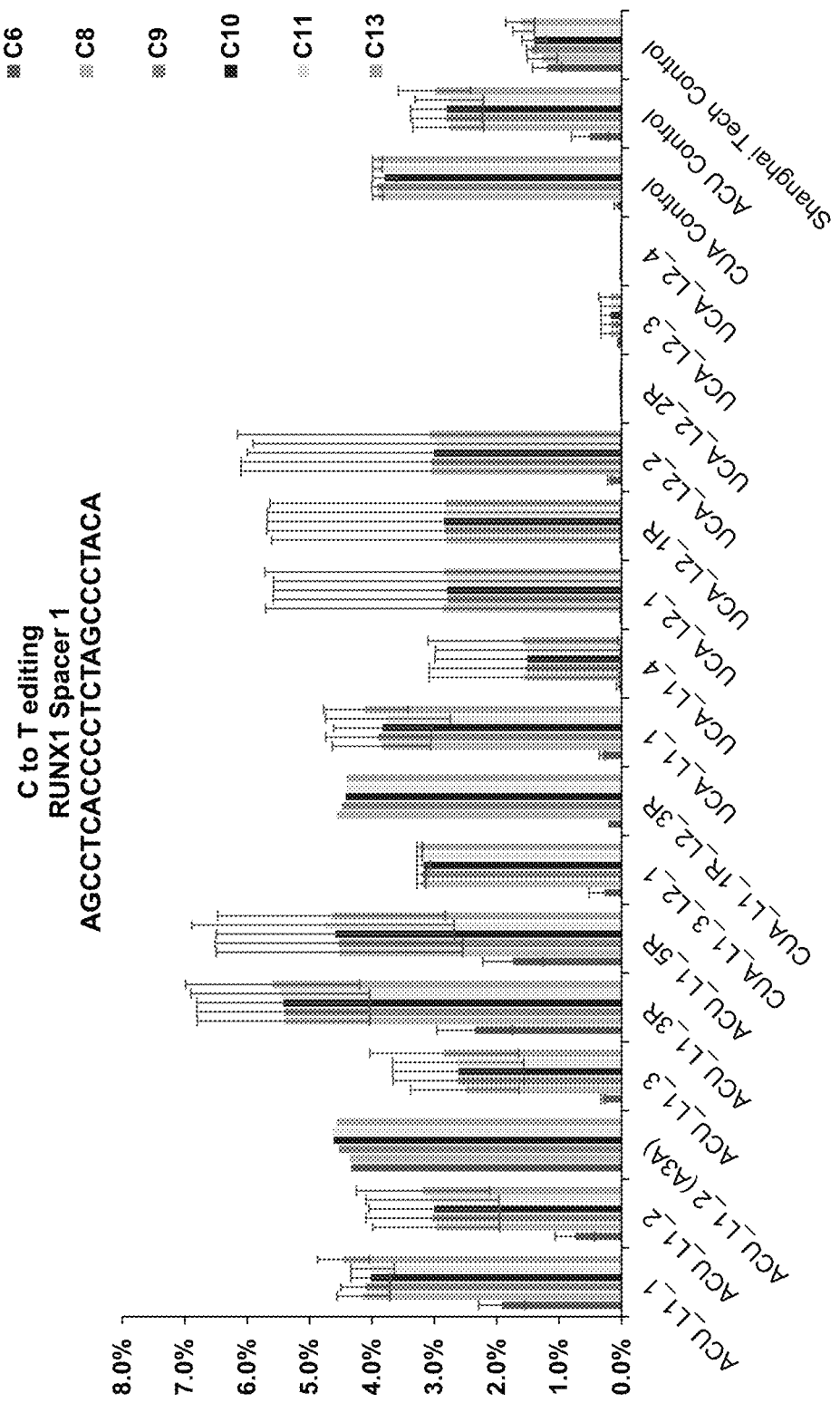
FIG. 18 shows the results of C to T editing using RUNX1 spacer 1: AGCCTCACCCCTCTAGCCCTACA (SEQ ID NO:84). The Y axis indicates the level of C→T editing observed for a given cytosine at the specified position within the spacer.
Figure 19:
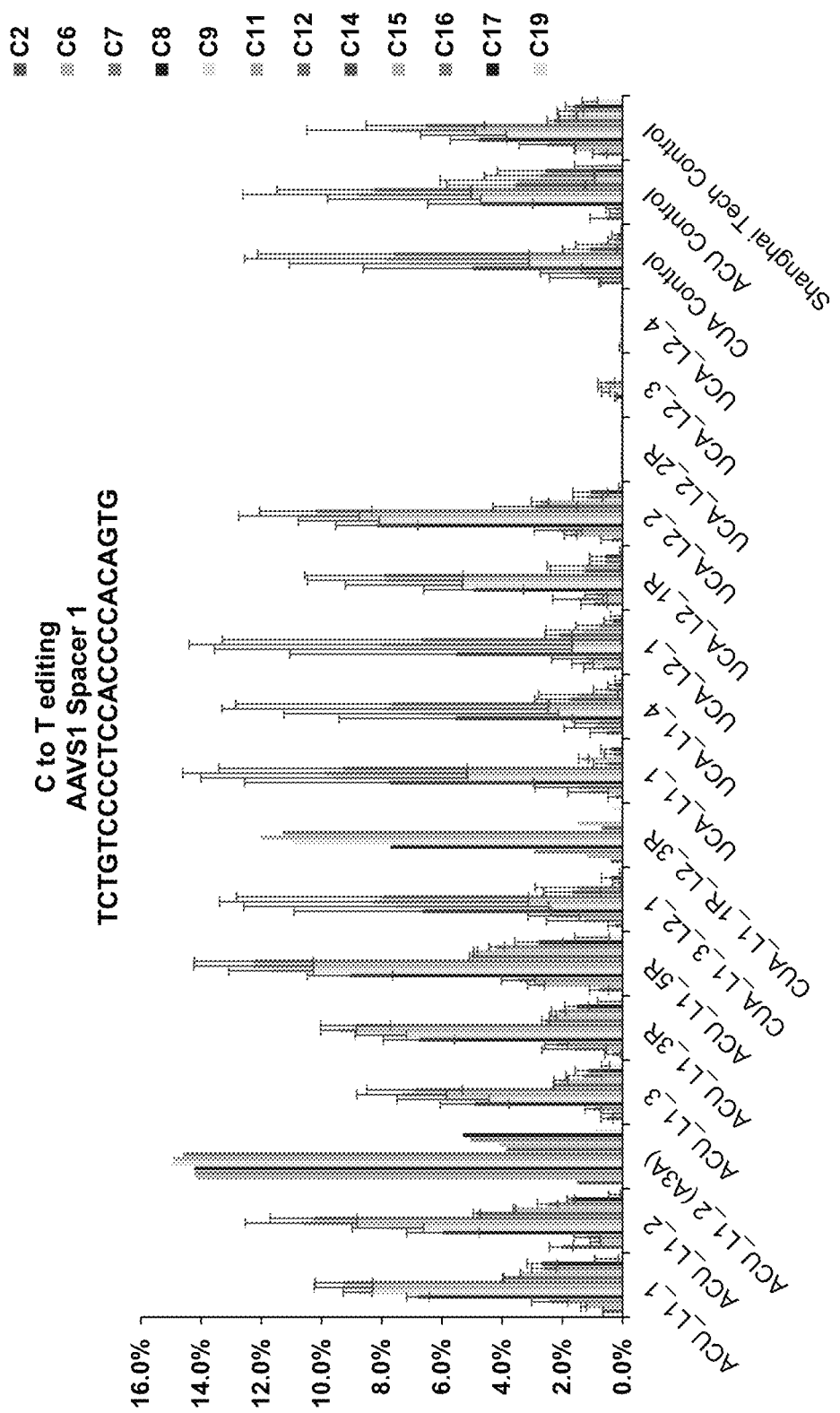
FIG. 19 shows the results of C to T editing using AAVS1 spacer 1: TCTGTCCCCTCCACCCCACAGTG (SEQ ID NO:88). The Y axis indicates the level of C→T editing observed for a given cytosine at the specified position within the spacer.
Figure 20:
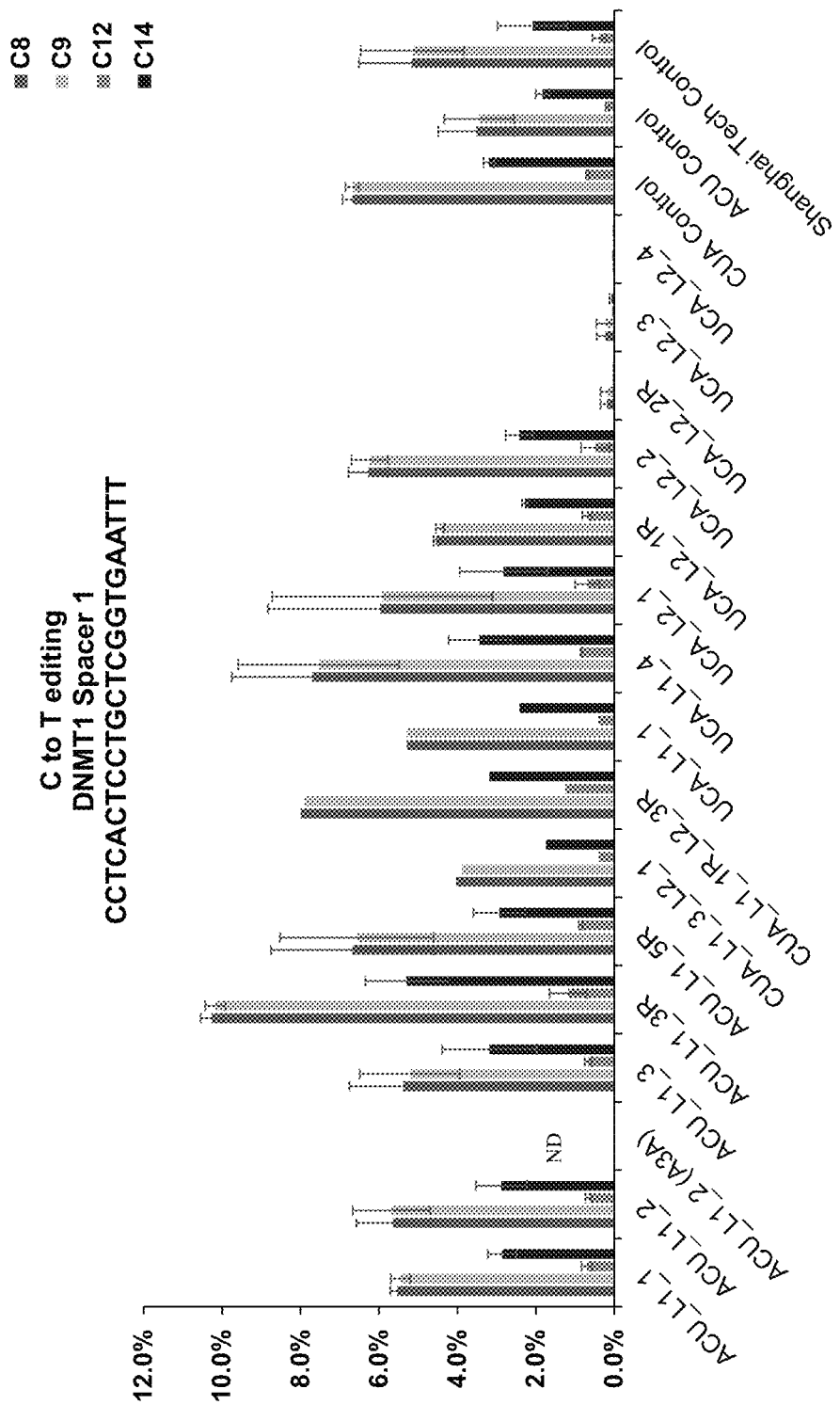
FIG. 20 shows the results of C to T editing using DNMT1 spacer 1: CCTCACTCCTGCTCGGTGAATTT (SEQ ID NO:86). The Y axis indicates the level of C→T editing observed for a given cytosine at the specified position within the spacer. No editing data is available for construct ACU_L1_2 (A3A)).
Figure 21:
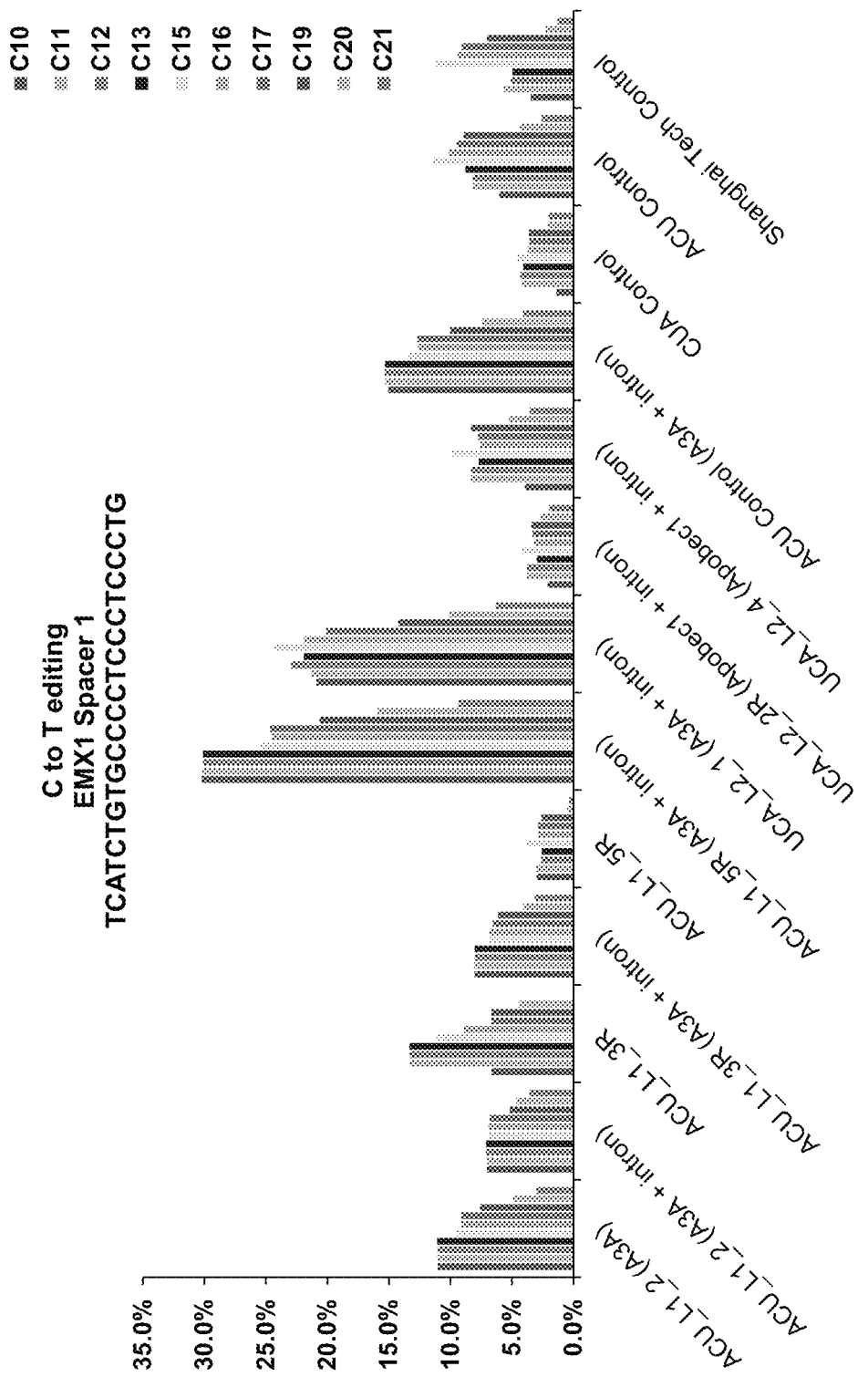
FIG. 21 shows the results of C to T editing using EMX1 spacer 1: TCATCTGTGCCCCTCCCTCCCTG (SEQ ID NO:83). The Y axis indicates the level of C→T editing observed for a given cytosine at the specified position within the spacer.
Figure 22:
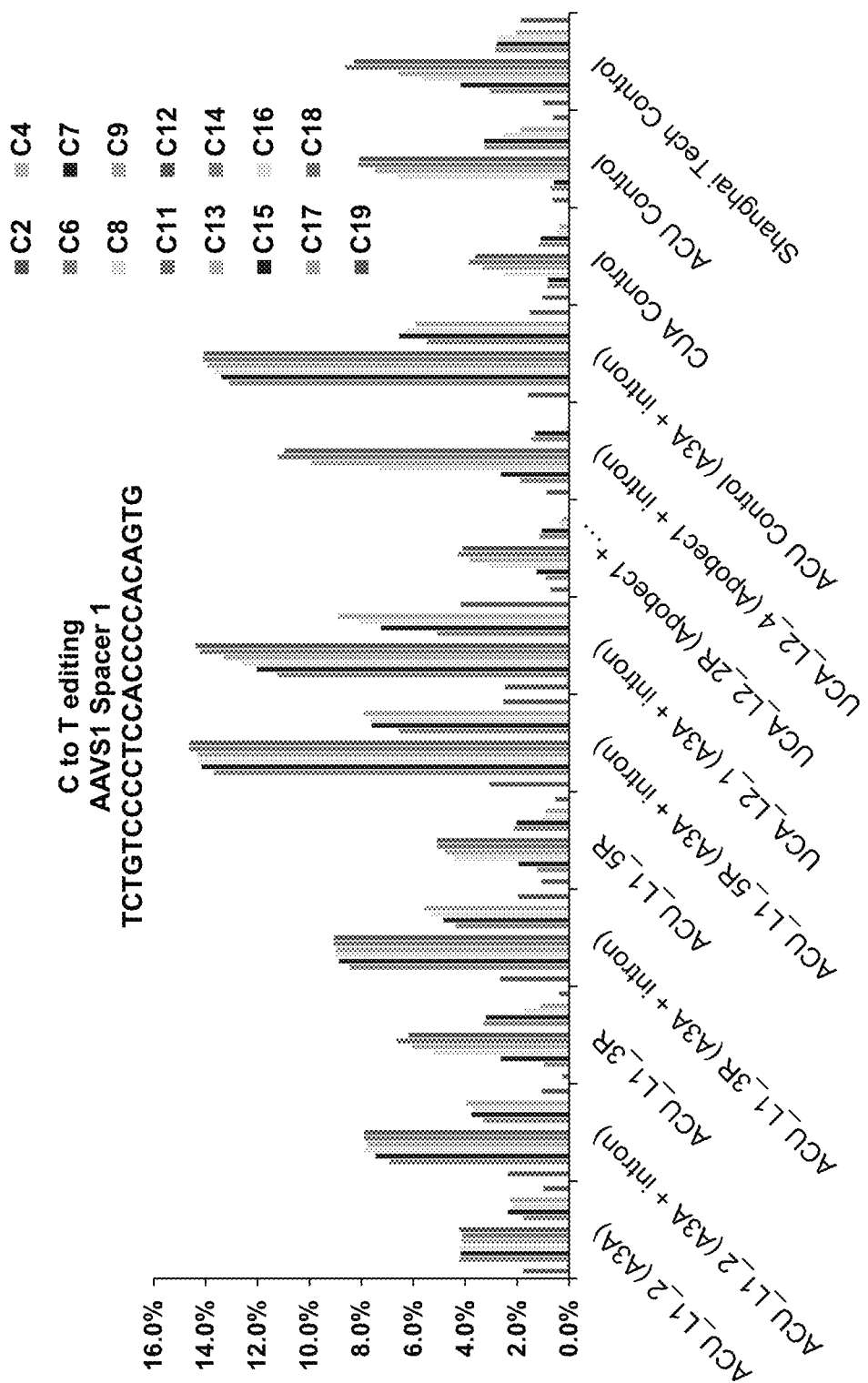
FIG. 22 shows the results of C to T editing using AAVS1 spacer 1: TCTGTCCCCTCCACCCCACAGTG (SEQ ID NO:88). The Y axis indicates the level of C→T editing observed for a given cytosine at the specified position within the spacer.
Figure 23:
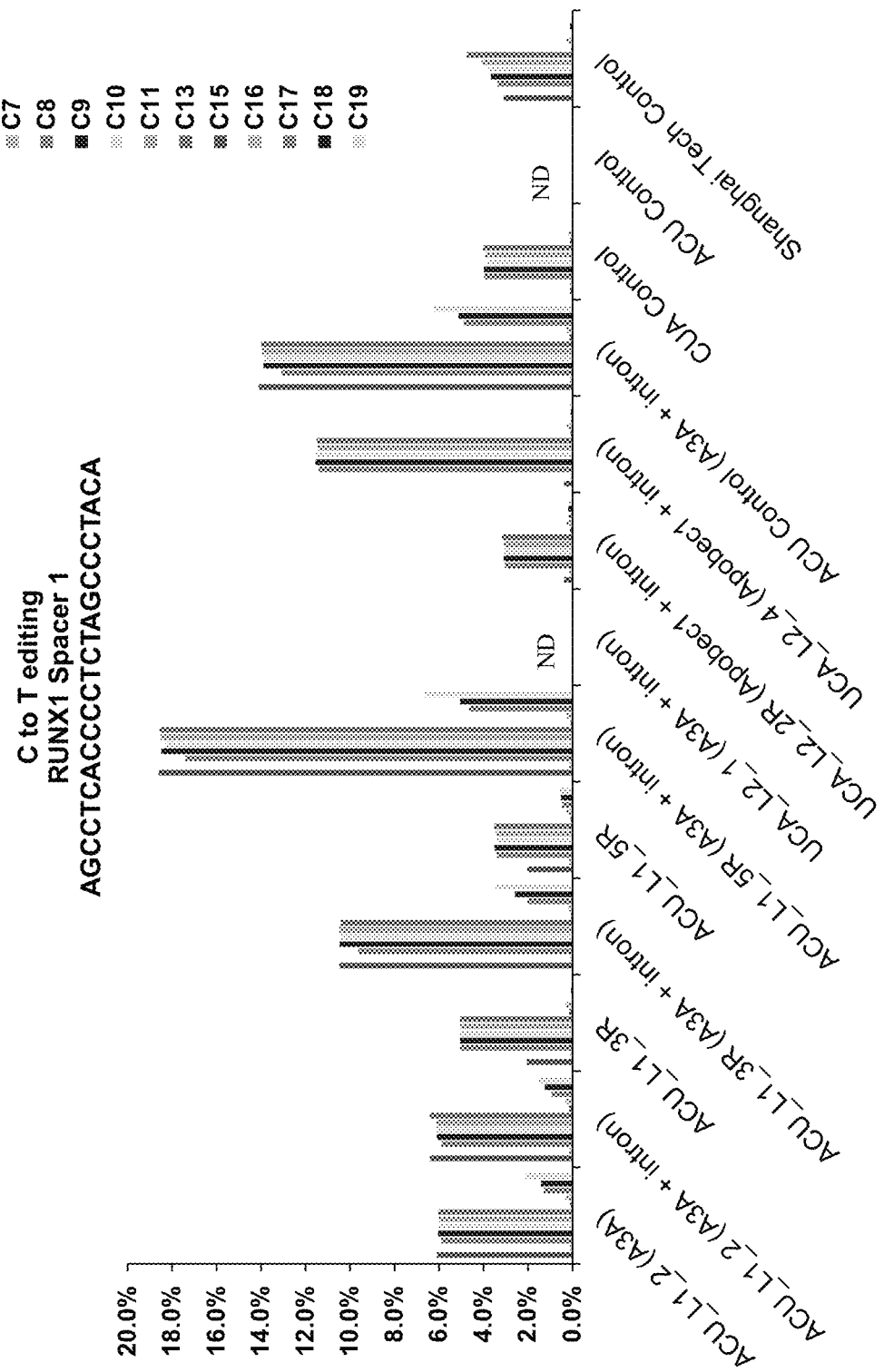
FIG. 23 shows the results of C to T editing using RUNX1 spacer 1: AGCCTCACCCCTCTAGCCCTACA (SEQ ID NO:84). The Y axis indicates the level of C→T editing observed for a given cytosine at the specified position within the spacer. No editing data (ND) is available for construct UC_L2_1 (A3A+intron) and ACU control.
Figure 24:
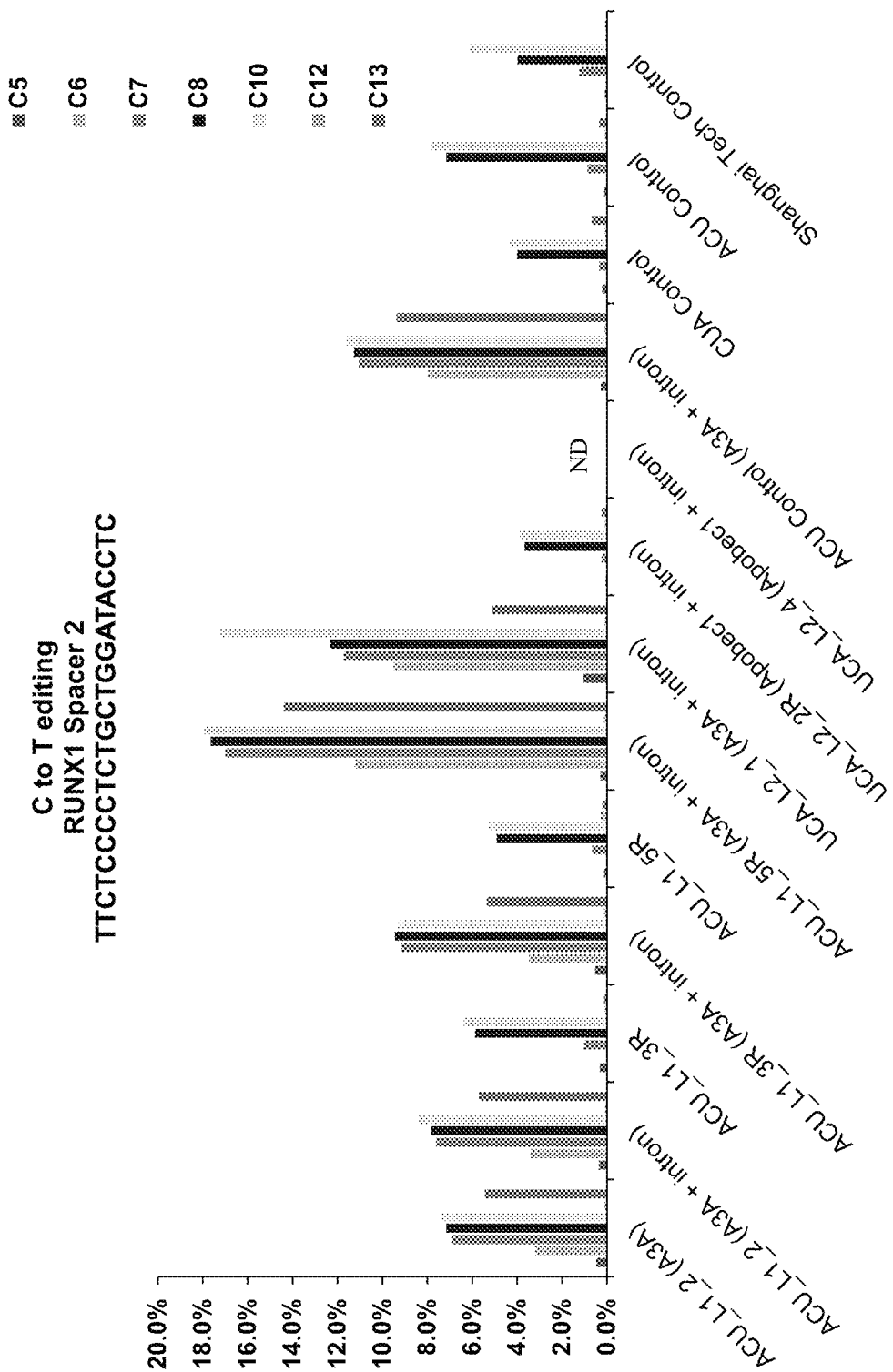
FIG. 24 shows the results of C to T editing using RUNX1 spacer 2: TTCTCCCCTCTGCTGGATACCTC (SEQ ID NO:85). The Y axis indicates the level of C→T editing observed for a given cytosine at the specified position within the spacer. No editing data (ND) is available for construct UC_L2_4.
Figure 25:
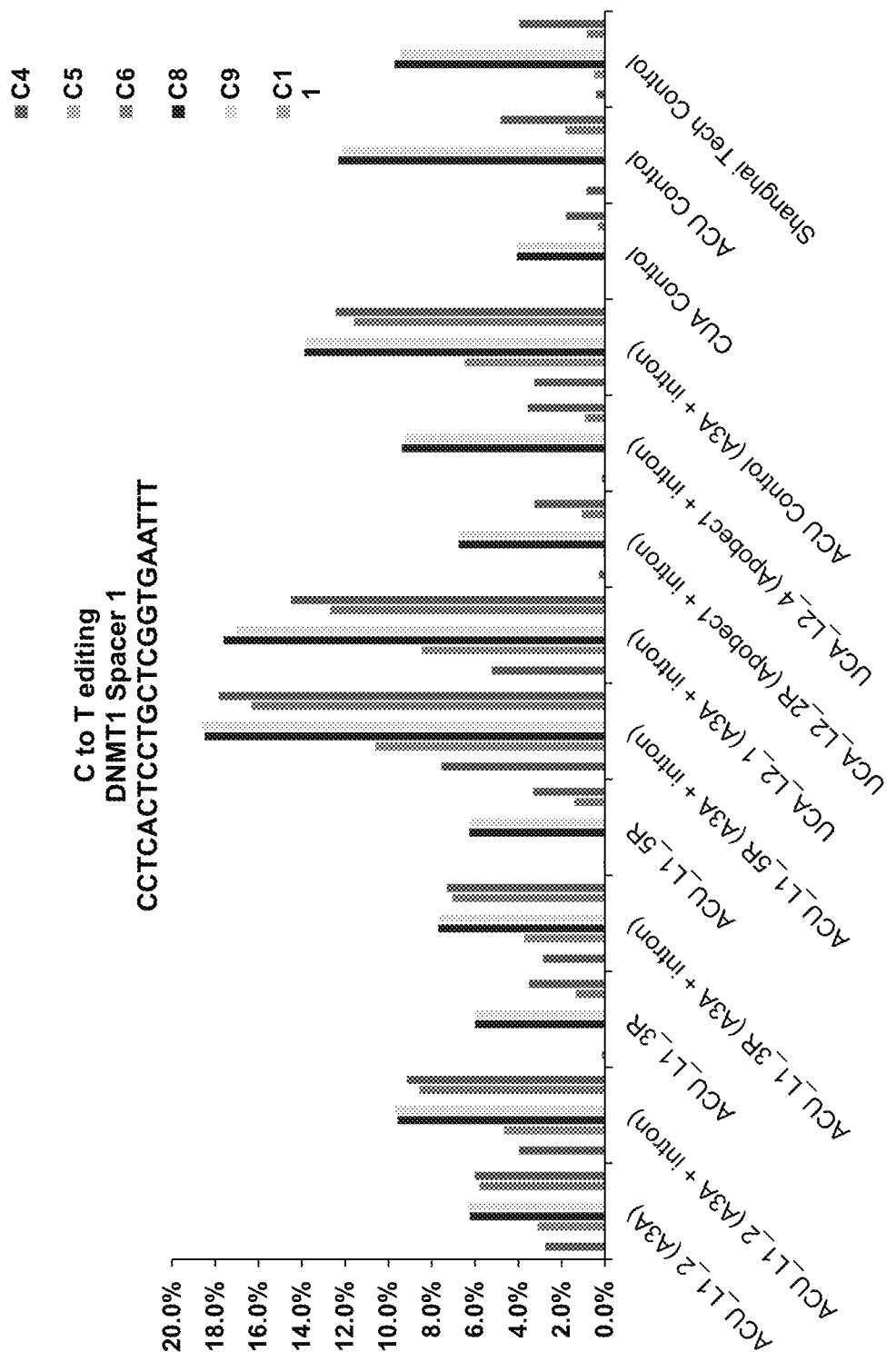
FIG. 25 shows the results of C to T editing using DNMT1 spacer 1: CCTCACTCCTGCTCGGTGAATTT (SEQ ID NO:86). The Y axis indicates the level of C→T editing observed for a given cytosine at the specified position within the spacer.

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

The term "about," as used herein when referring to a measurable value such as an amount or concentration and the like, is meant to encompass variations of ±10%, ±5%, ±1%, ±0.5%, or even ±0.1% of the specified value as well as the specified value. For example, "about X" where X is the measurable value, is meant to include X as well as variations of ±10%, ±5%, ±1%, ±0.5%, or even ±0.1% of X. A range provided herein for a measureable value may include any other range and/or individual value therein.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used herein, the terms "increase," "increasing," "increased," "enhance," "enhanced," "enhancing," and "enhancement" (and grammatical variations thereof) describe an elevation of at least about 25%, 50%, 75%, 100%, 150%, 200%, 300%, 400%, 500% or more as compared to a control.

As used herein, the terms "reduce," "reduced," "reducing," "reduction," "diminish," and "decrease" (and grammatical variations thereof), describe, for example, a decrease of at least about 5%, 10%, 15%, 20%, 25%, 35%, 50%, 75%, 80%, 85%, 90%, 95%, 97%, 98%, 99%, or 100% as compared to a control. In particular embodiments, the reduction can result in no or essentially no (i.e., an insignificant amount, e.g., less than about 10% or even 5%) detectable activity or amount.

A "heterologous" or a "recombinant" nucleotide sequence is a nucleotide sequence not naturally associated with a host cell into which it is introduced, including non-naturally occurring multiple copies of a naturally occurring nucleotide sequence.

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type mRNA" is an mRNA that is naturally occurring in or endogenous to the organism. A "homologous" nucleic acid sequence is a nucleotide sequence naturally associated with a host cell into which it is introduced.

As used herein, the terms "nucleic acid," "nucleic acid molecule," "nucleotide sequence" and "polynucleotide" refer to RNA or DNA that is linear or branched, single or double stranded, or a hybrid thereof. The term also encompasses RNA/DNA hybrids. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made.

As used herein, the term "nucleotide sequence" refers to a heteropolymer of nucleotides or the sequence of these nucleotides from the 5' to 3' end of a nucleic acid molecule and includes DNA or RNA molecules, including cDNA, a DNA fragment or portion, genomic DNA, synthetic (e.g., chemically synthesized) DNA, plasmid DNA, mRNA, and anti-sense RNA, any of which can be single stranded or double stranded. The terms "nucleotide sequence" "nucleic acid," "nucleic acid molecule," "oligonucleotide" and "polynucleotide" are also used interchangeably herein to refer to a heteropolymer of nucleotides. Nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25. A "5' region" as used herein can mean the region of a polynucleotide that is nearest the 5' end of the polynucleotide. Thus, for example, an element in the 5' region of a polynucleotide can be located anywhere from the first nucleotide located at the 5' end of the polynucleotide to the nucleotide located halfway through the polynucleotide. A "3' region" as used herein can mean the region of a polynucleotide that is nearest the 3' end of the polynucleotide. Thus, for example, an element in the 3' region of a polynucleotide can be located anywhere from the first nucleotide located at the 3' end of the polynucleotide to the nucleotide located halfway through the polynucleotide.

As used herein, the term "gene" refers to a nucleic acid molecule capable of being used to produce mRNA, antisense RNA, miRNA, anti-microRNA antisense oligodeoxyribonucleotide (AMO) and the like. Genes may or may not be capable of being used to produce a functional protein or gene product. Genes can include both coding and non-coding regions (e.g., introns, regulatory elements, promoters, enhancers, termination sequences and/or 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

As an example, an intron useful in a construct of the invention includes, but is not limited to, SEQ ID NO:89 or SEQ ID NO:90.

The term "mutation" refers to point mutations (e.g., missense, or nonsense, or insertions or deletions of single base pairs that result in frame shifts), insertions, deletions, and/or truncations. When the mutation is a substitution of a residue within an amino acid sequence with another residue, or a deletion or insertion of one or more residues within a sequence, the mutations are typically described by identifying the original residue followed by the position of the residue within the sequence and by the identity of the newly substituted residue.

The terms "complementary" or "complementarity," as used herein, refer to the natural binding of polynucleotides under permissive salt and temperature conditions by base-pairing. For example, the sequence "A-G-T" (5' to 3') binds to the complementary sequence "T-C-A" (3' to 5'). Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

"Complement" as used herein can mean 100% complementarity with the comparator nucleotide sequence or it can mean less than 100% complementarity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity).

A "portion" or "fragment" of a nucleotide sequence of the invention will be understood to mean a nucleotide sequence of reduced length relative (e.g., reduced by 1, 2, 3, 4, 5, 6, 7, 8, 9, 10, 11, 12, 13, 14, 15, 16, 17, 18, 19, 20 or more nucleotides) to a reference nucleic acid or nucleotide sequence and comprising, consisting essentially of and/or consisting of a nucleotide sequence of contiguous nucleotides identical or almost identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to the reference nucleic acid or nucleotide sequence. Such a nucleic acid fragment or portion according to the invention may be, where appropriate, included in a larger polynucleotide of which it is a constituent. As an example, a repeat sequence of guide nucleic acid of this invention may comprise a portion of a wild type Cas12a repeat sequence.

As used herein with respect to polypeptides, the term "fragment" or "portion" may refer to a polypeptide that is reduced in length relative to a reference polypeptide and that comprises, consists essentially of and/or consists of an amino acid sequence of contiguous amino acids identical or almost identical (e.g., 90%, 91%, 92%, 93%, 94%, 95%, 96%, 97%, 98%, 99% identical) to a corresponding portion of the reference polypeptide. Such a polypeptide fragment may be, where appropriate, included in a larger polypeptide of which it is a constituent. In some embodiments, the polypeptide fragment comprises, consists essentially of or consists of at least about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 260, 270, 280, 290, or more consecutive amino acid residues of a reference polypeptide.

Different nucleic acids or proteins having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity (e.g., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity (e.g., at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to said nucleotide sequence of the invention.

As used herein "sequence identity" refers to the extent to which two optimally aligned polynucleotide or polypeptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data, Part I* (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence as compared to a reference polypeptide.

As used herein, the phrase "substantially identical," or "substantial identity" in the context of two nucleic acid molecules, nucleotide sequences or protein sequences, refers to two or more sequences or subsequences that have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% nucleotide or amino acid residue identity, when compared and aligned for maximum correspondence, as measured using one of the following sequence comparison algorithms or by visual inspection. In some embodiments of the invention, the substantial identity exists over a region of consecutive nucleotides of a nucleotide sequence of the invention that is about 10 nucleotides to about 30 nucleotides, about 15 nucleotides to about 25 nucleotides, about 30 nucleotides to about 40 nucleotides, about 50 nucleotides to about 60 nucleotides, about 70 nucleotides to about 80 nucleotides, about 90 nucleotides to about 100 nucleotides, or more nucleotides in length, and any range therein, up to the full length of the sequence. In some embodiments, the nucleotide sequences can be substantially identical over at least about 20 nucleotides (e.g., about 20, 21, 22, 23, 24, 25, 26, 27, 28, 29, 30, 31, 32, 33, 34, 35, 36, 37, 38, 39, 40 nucleotides). In some embodiments, a substantially identical nucleotide or protein sequence performs substantially the same function as the nucleotide (or encoded protein sequence) to which it is substantially identical.

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, Calif.). An "identity fraction" for aligned segments of a test sequence and a reference sequence is the number of identical components which are shared by the two aligned sequences divided by the total number of components in the reference sequence segment, e.g., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Two nucleotide sequences may also be considered substantially complementary when the two sequences hybridize to each other under stringent conditions. In some representative embodiments, two nucleotide sequences considered to be substantially complementary hybridize to each other under highly stringent conditions.

"Stringent hybridization conditions" and "stringent hybridization wash conditions" in the context of nucleic acid hybridization experiments such as Southern and Northern hybridizations are sequence dependent, and are different under different environmental parameters. An extensive guide to the hybridization of nucleic acids is found in Tijssen *Laboratory Techniques in Biochemistry and Molecular Biology—Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

Any nucleotide sequence, polynucleotide and/or recombinant nucleic acid construct of this invention can be codon optimized for expression in any organism of interest. Codon optimization is well known in the art and involves modification of a nucleotide sequence for codon usage bias using species specific codon usage tables. The codon usage tables are generated based on a sequence analysis of the most highly expressed genes for the organism/species of interest. When the nucleotide sequences are to be expressed in the nucleus, the codon usage tables are generated based on a sequence analysis of highly expressed nuclear genes for the species of interest. The modifications of the nucleotide sequences are determined by comparing the species specific codon usage table with the codons present in the native polynucleotide sequences. As is understood in the art, codon optimization of a nucleotide sequence results in a nucleotide sequence having less than 100% identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, or 99.9% and any range or value therein) to the native nucleotide sequence but which still encodes a polypeptide having the same function as that encoded by the original, native nucleotide sequence. Thus, in some embodiments of the invention, the polynucleotides, nucleic acid constructs, expression cassettes, and/or vectors of the invention (comprising/encoding the polypeptides, fusion proteins, complexes of the invention, e.g., Cas12a, polypeptide of interest, cytosine deaminase, linkers) may be codon optimized for expression in a particular species of interest, e.g., a particular plant species, a particular bacterial species, a particular animal species, and the like. In some embodiments, the codon optimized polynucleotides, nucleic acid constructs, expression cassettes, and/or vectors of the invention have about 70% to about 99.9% (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.9% or 100%) identity or more to the polynucleotides, nucleic acid constructs, expression cassettes, and/or vectors of the invention not having been codon optimized.

In any of the embodiments described herein, a polynucleotide or nucleic acid construct of the invention may be operatively associated with a variety of promoters and other regulatory elements for expression in an organism of interest and/or a cell of an organism of interest. Thus, in some embodiments, an expression cassette or vector comprising a polynucleotide or nucleic acid construct of the invention may further comprise one or more promoters, enhancers, and/or terminators operably linked to the one or more polynucleotides or nucleic acid constructs.

By "operably linked" or "operably associated" as used herein, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, sequences can be present between a promoter and a nucleotide sequence, and the promoter can still be considered "operably linked" to the nucleotide sequence.

As used herein, the term "linked," in reference to polypeptides, refers to the attachment of one polypeptide to another. A polypeptide may be linked to another polypeptide (at the N-terminus or the C-terminus) directly (e.g., via a peptide bond) or through a linker.

The term "linker" is art-recognized and refers to a bond, chemical group, or a molecule linking two molecules or moieties, e.g., two domains of a fusion protein, such as, for example, a Cas12a domain and a nucleic acid-editing domain (e.g., an cytosine deaminase). A linker may be comprised of a single linking molecule (e.g., an amino acid) or may comprise more than one linking molecule. In some embodiments, the linker can be an organic molecule, group, polymer, or chemical moiety. In some embodiments, the linker may be an amino acid or a peptide linker. In some embodiments, a peptide linker may be about 4, 5 to 100 or more amino acids in length, for example, 4, 5, 6, 7, 8, 9, 10, 11, 12, 13, 14, 15, 16, 17, 18, 19, 20, 21, 22, 23, 24, 25, 26, 27, 28, 29, 30, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length. In some embodiments, a peptide linker may be a GS linker. In some embodiments, the linker may comprise the amino acid sequence SGGS (SEQ ID NO:25), (GGS)n, or S(GGS)n (one or more repeats of SEQ ID NO:25), wherein n is 1-20 (e.g., 1, 2, 3, 4, 5, 6, 7, 8, 9, 10, 11, 12, 13, 14, 15, 16, 17, 18, 19, 20, and any range or value therein). In some embodiments, the linker may comprise the amino acid sequence SGGSGGSGGS (SEQ ID NO:26). In some embodiments, the linker may comprise the amino acid sequence, SGSETPGTSESATPES (SEQ ID NO:27), also referred to as the XTEN linker. In some embodiments, a linker may comprise the amino acid sequence SGGSSGGSSGSETPGTSESATPESSGGSSGGS (SEQ ID NO:28), also referred to as the GS-XTEN-GS linker. In some embodiments, a linker comprises, consists essentially of, or consists of any one of the amino acid sequences of SEQ ID NOs:1-24.

A "promoter" is a nucleotide sequence that controls or regulates the transcription of a nucleotide sequence (e.g., a coding sequence) that is operably associated with the promoter. The coding sequence controlled or regulated by a promoter may encode a polypeptide and/or a functional RNA. Typically, a "promoter" refers to a nucleotide sequence that contains a binding site for RNA polymerase II and directs the initiation of transcription. In general, promoters are found 5', or upstream, relative to the start of the coding region of the corresponding coding sequence. The promoter region may comprise other elements that act as regulators of gene expression. These include a TATA box consensus sequence, and often a CAAT box consensus sequence (Breathnach and Chambon, (1981) *Annu. Rev. Biochem.* 50:349). In plants, the CAAT box may be substituted by the AGGA box (Messing et al., (1983) in Genetic Engineering of Plants, T. Kosuge, C. Meredith and A. Hollaender (eds.), Plenum Press, pp. 211-227).

Promoters can include, for example, constitutive, inducible, temporally regulated, developmentally regulated, chemically regulated, tissue-preferred and/or tissue-specific promoters for use in the preparation of recombinant nucleic acid molecules, e.g., "synthetic nucleic acid constructs" or "protein-RNA complex." These various types of promoters are known in the art.

The choice of promoter may vary depending on the temporal and spatial requirements for expression, and also may vary based on the host cell to be transformed. Promoters for many different organisms are well known in the art. Based on the extensive knowledge present in the art, the appropriate promoter can be selected for the particular host organism of interest. Thus, for example, much is known about promoters upstream of highly constitutively expressed genes in model organisms and such knowledge can be readily accessed and implemented in other systems as appropriate.

In some embodiments, a polynucleotide and/or a nucleic acid construct of the invention can be an "expression cassette" or can be comprised within an expression cassette. As used herein, "expression cassette" means a recombinant nucleic acid molecule comprising, for example, a nucleic acid construct of the invention (e.g., encoding a complex of the invention (e.g., a fusion protein of the invention and guide nucleic acid)), wherein the nucleic acid construct is operably associated with at least a control sequence (e.g., a promoter). Thus, some embodiments of the invention provide expression cassettes designed to express, for example, a nucleic acid construct of the invention.

An expression cassette comprising a nucleotide sequence of interest may be chimeric, meaning that at least one of its components is heterologous with respect to at least one of its other components (e.g., a promoter from the host organism operably linked to a polynucleotide of interest to be expressed in the host organism, wherein the polynucleotide of interest is from a different organism than the host or is not normally found in association with that promoter). An expression cassette may also be one that is naturally occurring but has been obtained in a recombinant form useful for heterologous expression.

An expression cassette may optionally include a transcriptional and/or translational termination region (i.e., termination region) and/or an enhancer region that is functional in the selected host cell. A variety of transcriptional terminators and/or enhancers are available for use in expression cassettes and are responsible for the termination of transcription and correct mRNA polyadenylation. The termination region and/or enhancer region may be native to the transcriptional initiation region, may be native to the operably linked nucleotide sequence of interest, may be native to the host cell, or may be from another source (e.g., foreign or heterologous to the promoter, to the nucleotide sequence of interest, to the host, or any combination thereof).

An expression cassette of the invention also can include a nucleotide sequence encoding a selectable marker, which can be used to select a transformed host cell. As used herein, "selectable marker" means a nucleotide sequence that when expressed imparts a distinct phenotype to the host cell expressing the marker and thus allows such transformed cells to be distinguished from those that do not have the marker. Such a nucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Many examples of suitable selectable markers are known in the art and can be used in the expression cassettes described herein.

In addition to expression cassettes, the nucleic acid molecules/constructs and polynucleotide sequences described herein can be used in connection with vectors. The term "vector" refers to a composition for transferring, delivering or introducing a nucleic acid (or nucleic acids) into a cell. A vector comprises a nucleic acid molecule comprising the nucleotide sequence(s) to be transferred, delivered or introduced. Vectors for use in transformation of host organisms are well known in the art. Non-limiting examples of general classes of vectors include but are not limited to a viral vector, a plasmid vector, a phage vector, a phagemid vector, a cosmid vector, a fosmid vector, a bacteriophage, an artificial chromosome, minicircle, or an *Agrobacterium* binary vector in double or single stranded linear or circular form which may or may not be self transmissible or mobilizable. In some embodiments, a viral vector can include, but is not limited to, a retroviral, lentiviral, adenoviral, adeno-associated, or herpes simplex viral vector. A vector as defined herein can transform a prokaryotic or eukaryotic host either by integration into the cellular genome or exist extrachromosomally (e.g. autonomous replicating plasmid with an origin of replication). Additionally included are shuttle vectors by which is meant a DNA vehicle capable, naturally or by design, of replication in two different host organisms, which may be selected from actinomycetes and related species, bacteria and eukaryotic (e.g. higher plant, mammalian, yeast or fungal cells). In some embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter or other regulatory elements and in the case of cDNA this may be under the control of an appropriate promoter or other regulatory elements for expression in the host cell. Accordingly, a polynucleotide and a nucleic acid construct of this invention, and/or expression cassettes comprising the same may be comprised in vectors as described herein and as known in the art.

As used herein, "contact", contacting", "contacted," and grammatical variations thereof, refers to placing the components of a desired reaction together under conditions suitable for carrying out the desired reaction (e.g., transformation, transcriptional control, genome editing, nicking, and/or cleavage). Thus, for example, a target nucleic acid may be contacted with a fusion protein of the invention and a guide nucleic acid, thereby modifying the target nucleic acid. In some embodiments, a target DNA may be contacted with a polynucleotide or nucleic acid construct encoding a fusion protein of the invention and a guide nucleic acid under conditions wherein the fusion protein is expressed and forms a complex with the guide nucleic acid, with the complex then hybridizing to the target nucleic acid to modify the target nucleic acid.

As used herein, "modifying" or "modification" in reference to a target nucleic acid includes editing (e.g., mutating), covalent modification, exchanging/substituting nucleic acids/nucleotide bases, deleting, cleaving, nicking, and/or transcriptional control of a target nucleic acid.

"Introducing," "introduce," "introduced" (and grammatical variations thereof) in the context of a polynucleotide of interest means presenting a nucleotide sequence of interest (e.g., polynucleotide, a nucleic acid construct, a complex (e.g., protein-RNA chimeric complex), and/or a guide nucleic acid) to a host organism or cell of said organism (e.g., host cell) in such a manner that the nucleotide sequence gains access to the interior of a cell. Thus, for example, a polynucleotide encoding a fusion protein of the invention and guide nucleic acid may be introduced into a cell of an organism, thereby transforming the cell.

The term "transformation" as used herein refers to the introduction of a heterologous nucleic acid into a cell. Transformation of a cell may be stable or transient. Thus, in some embodiments, a host cell or host organism is stably transformed with a nucleic acid molecule of the invention. In other embodiments, a host cell or host organism is transiently transformed with a recombinant nucleic acid molecule of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein includes the nuclear and the plastid genome, and therefore includes integration of the nucleic acid into, for example, the chloroplast or mitochondrial genome. Stable transformation as used herein can also refer to a transgene that is maintained extrachromasomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant). Stable transformation of a cell can be detected by, for example, a Northern blot hybridization assay of RNA of the cell with nucleic acid sequences which specifically hybridize with a nucleotide sequence of a transgene introduced into a host organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

Accordingly, in some embodiments, the nucleotide sequences, nucleic acid constructs, and/or expression cassettes of the invention may be expressed transiently and/or they may be stably incorporated into the genome of the host organism. Thus, in some embodiments, a fusion protein of the invention or polynucleotide encoding the same may be introduced into a cell with a guide nucleic acid and as such no DNA maintained in the cell.

A nucleic acid construct/polynucleotide of the invention can be introduced into a cell by any method known to those of skill in the art. In some embodiments of the invention, transformation of a cell comprises nuclear transformation. In other embodiments, transformation of a cell comprises plastid transformation (e.g., chloroplast transformation). In still further embodiments, a nucleic acid construct/polynucleotide of the invention can be introduced into a cell via conventional breeding techniques.

Procedures for transforming both eukaryotic and prokaryotic organisms are well known and routine in the art and are described throughout the literature (See, for example, Jiang et al. 2013. Nat. Biotechnol. 31:233-239; Ran et al. *Nature Protocols* 8:2281-2308 (2013)).

A nucleotide sequence therefore can be introduced into a host organism or its cell in any number of ways that are well known in the art. The methods of the invention do not depend on a particular method for introducing one or more nucleotide sequences into the organism, only that they gain access to the interior of at least one cell of the organism. Where more than one nucleotide sequence is to be introduced, they can be assembled as part of a single nucleic acid construct, or as separate nucleic acid constructs, and can be located on the same or different nucleic acid constructs. Accordingly, the nucleotide sequences can be introduced into the cell of interest in a single transformation event, or in separate transformation events, or, alternatively, where relevant, a nucleotide sequence can be incorporated into a plant, for example, as part of a breeding protocol.

The present invention is directed to polypeptides (e.g., SEQ ID NOs:1-24) that may be used, for example, to link two or more proteins/protein domains. In some embodiments, a polypeptide of the invention may be about 70% to 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to any one of the amino acid sequences of SEQ ID NOs:1-24. In some embodiments, the invention provides polynucleotides encoding any one of the amino acid sequences of SEQ ID NOs:1-24 and/or polynucleotides having 70% to 100% identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical) to the polynucleotides encoding any one of the amino acid sequences of SEQ ID NOs:1-24. In some embodiments, the polynucleotides encoding any one of the amino acid sequences of SEQ ID NOs:1-24 may be codon optimized for expression in an organism.

The present invention is also directed to synthetic fusion proteins comprising these polypeptides. In some embodiments, the invention provides polypeptides comprising any one of the amino acid sequences of SEQ ID NOs: 1-24 and a polypeptide of interest. In some embodiments, a polypeptide of interest may be linked at its C-terminus and/or its N-terminus to any one of the amino acid sequences of SEQ ID NOs: 1-24, optionally at the C- and/or N-terminus. In some embodiments, a polypeptide of interest may comprise two or more polypeptides of interest (e.g., 2, 3, 4, 5, 6, 7 or more), which may be the same or different, wherein at least two of the two or more polypeptides of interest may be linked to one another via any one of the amino acid sequences of SEQ ID NOs: 1-24.

A polypeptide of interest useful with this invention can include, but is not limited to a polypeptide or protein domain having deaminase (deamination) activity (e.g., cytosine deaminase, adenine deaminase), nickase activity, recombinase activity, transposase activity, methylase activity, glycosylase (DNA glycosylase) activity, glycosylase inhibitor activity (e.g., uracil-DNA glycosylase inhibitor (UGI), demethylase activity, transcription activation activity, transcription repression activity, transcription release factor activity, histone modification activity, nuclease activity, single-strand RNA cleavage activity, double-strand RNA cleavage activity, restriction endonuclease activity (e.g., Fok1), nucleic acid binding activity, methyltransferase activity, DNA repair activity, DNA damage activity, dismutase activity, alkylation activity, depurination activity, oxidation activity, pyrimidine dimer forming activity, integrase activity, transposase activity, polymerase activity, ligase activity, helicase activity, and/or photolyase activity. In some embodiments, the polypeptide of interest is an adenine deaminase, cytosine deaminase, a Fok1 nuclease, or a uracil-DNA glycosylase inhibitor. In some embodiments, a polynucleotide of interest may be codon optimized for expression in an organism.

In some embodiments, the polypeptide of interest is a CRISPR Cas12a polypeptide or Cas12a domain, wherein the Cas12a is linked at its C-terminus and/or N-terminus to the C-terminus or N-terminus of any one of the amino acid sequences of SEQ ID NOs: 1-24.

In some embodiments, a fusion protein is provided comprising a Cas12a, a polypeptide of interest, and any one of the amino acid sequences of SEQ ID NOs: 1-24. In some embodiments, the amino acid sequences of SEQ ID NOs: 1-24 enable optimal placement of Cas12a and one or more (e.g., 1, 2, 3, 4, 5, 6, 7 or more) polypeptides of interest (e.g., cytosine deaminase domains, glycosylase inhibitor (e.g., uracil-DNA glycosylase inhibitor (UGI)) relative to the Cas12a domain. The amino acid sequences of SEQ ID NOs:1-24 may be used to link a Cas12a and polypeptide of interest(s) in a manner that allows access to the single-stranded portion of the non-target strand for, e.g., nucleic acid modification, e.g., base editing.

In some embodiments, the amino acid sequences of SEQ ID NOs: 1-24 when used to link Cas12a with a polypeptide of interest may provide different windows for modifying or editing of nucleic acids. For example, the amino acid sequences of SEQ ID NOs: 1-24 linking a polypeptide of interest to Cas12a may provide a window for editing or modifying of 1 to about 25 nucleotides from a corresponding PAM (protospacer adjacent motif) in a target nucleic acid (e.g., DNA) (e.g., an editing/modifying window of 1, 2, 3, 4, 5, 6, 7, 8, 9, 10, 11, 12, 13, 14, 15, 16, 17, 18, 19, 20, 21, 22, 23, 24, or 25 nucleotides from the PAM and any range or value therein). In some embodiments, an editing or modifying window may be 1, 2, 3, 4, 5, 6, 7, 8, 9, 10, to about 11, 12, 13, 14, 15, 16, 17, 18, 19, 20, 21, 22, 23, 24, 25 nucleotides from a PAM (e.g., 1 to 20, 1 to 15, 1 to 10, 3 to 15, 4 to 10, 5 to 25, 5 to 20, 5 to 15, 5 to 10, 7 to 15 nucleotides and the like, from the PAM).

Cas12a is a Type V Clustered Regularly Interspaced Short Palindromic Repeats (CRISPR)-Cas nuclease. Cas12a differs in several respects from the more well-known Type II CRISPR Cas9 nuclease. For example, Cas9 recognizes a G-rich protospacer-adjacent motif (PAM) that is 3' to its guide RNA (gRNA, sgRNA) binding site (protospacer, target nucleic acid, target DNA) (3'-NGG), while Cas12a recognizes a T-rich PAM that is located 5' to the target nucleic acid (5'-ttN, 5'TTTN). In fact, the orientations in which Cas9 and Cas12a bind their guide RNAs are very nearly reversed in relation to their N and C termini. Furthermore, Cas12a enzymes use a single guide RNA (gRNA, CRISPR array, crRNA) rather than the dual guide RNA (sgRNA (e.g., crRNA and tracrRNA)) found in natural Cas9 systems, and Cas12a processes its own gRNAs. Additionally, Cas12a nuclease activity produces staggered DNA double stranded breaks instead of blunt ends produced by Cas9 nuclease activity, and Cas12a relies on a single RuvC domain to cleave both DNA strands, whereas Cas9 utilizes an HNH domain and a RuvC domain for cleavage.

A CRISPR Cas12a polypeptide or CRISPR Cas12a domain useful with this invention may be any known or later identified Cas12a nuclease (previously known as Cpf1) (see, e.g., U.S. Pat. No. 9,790,490, which is incorporated by reference for its disclosures of Cpf1 (Cas12a) sequences). The term "Cas12a", "Cas12a polypeptide" or "Cas12a domain" refers to an RNA-guided nuclease comprising a Cas12a polypeptide, or a fragment thereof, which comprises the guide nucleic acid binding domain of Cas12a and/or an active, inactive, or partially active DNA cleavage domain of Cas12a. In some embodiments, a Cas12a useful with the invention may comprise a mutation in the nuclease active site (e.g., RuvC site of the Cas12a domain). A Cas12a domain or Cas12a polypeptide having a mutation in its nuclease active site, and therefore, no longer comprising nuclease activity, is commonly referred to as deadCas12a (e.g., dCas12a). In some embodiments, a Cas domain or Cas12a polypeptide having a mutation in its nuclease active site may have impaired activity.

In some embodiments, a Cas12a domain can include, but is not limited to, the amino acid sequence of any one of SEQ ID NOs:29-45 (e.g., SEQ ID NOs:29, 30, 31, 32, 33, 34, 35, 36, 37, 38, 39, 40, 41, 42, 43, 44, 45, 45); or a polynucleotide encoding the same. In some embodiments, a fusion protein of the invention may comprise a Cas12a domain from Lachnospiraceae bacterium ND2006 Cas12a (LbCas12a) (e.g., SEQ ID NO:29).

In some embodiments, a polynucleotide encoding the Cas12a domain may be codon optimized for expression in an organism. Thus, in some embodiments, the invention provides a polynucleotide having at least about 70% identity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 100% identity) to a polynucleotide encoding the amino acid sequence of any one of SEQ ID NOs:29-45.

In some embodiments, a Type V Clustered Regularly Interspaced Short Palindromic Repeats (CRISPR)-associated (Cas) (CRISPR-Cas) system is provided, the system comprising: (a) a fusion protein comprising a Cas12a domain, a linker comprising any one of the amino acid sequences of SEQ ID NOs: 1-24, and a polypeptide of interest, or a nucleic acid encoding the fusion protein; wherein the Cas12a domain is linked to the polypeptide of interest via any one of the amino acid sequences of SEQ ID NOs: 1-24; and (b) a guide nucleic acid (CRISPR RNA, CRISPR DNA, crRNA, crDNA) comprising a spacer sequence and a repeat sequence, wherein the guide nucleic acid is capable of forming a complex with the Cas12a domain of the fusion protein and the spacer sequence is capable of hybridizing to a target nucleic acid, thereby guiding the Cas12a domain and the polypeptide of interest to the target nucleic acid, whereby the system is capable of modifying (e.g., cleaving or editing) or modulating (e.g., modulating transcription) the target nucleic acid.

In some embodiments, a fusion protein is provided comprising a Cas12a, a polypeptide of interest, and any one of the amino acid sequences of SEQ ID NOs: 1-24 wherein the polypeptide of interest is an cytosine deaminase polypeptide or domain.

In some embodiments, the present invention provides a fusion protein comprising: (a) a Cas12a domain, wherein the Cas12a domain, when in conjunction with a bound guide nucleic acid (e.g., gRNA), specifically binds to a target nucleic acid sequence; (b) a cytidine deaminase domain, wherein the cytidine deaminase domain deaminates a cytosine base in a single-stranded portion of the target nucleic acid sequence when in conjunction with the Cas12a domain and the gRNA; and (c) a uracil glycosylase inhibitor (UGI) domain, wherein the UGI domain inhibits a uracil-DNA glycosylase, wherein the Cas12a domain is linked to the cytosine deaminase domain or the UGI domain via any one of the amino acid sequence of SEQ ID NOs:1-24. In some embodiments, the N-terminus of the Cas12a domain may be linked to the C-terminus of the cytosine deaminase domain via any one of the amino acid sequences of SEQ ID NOs:1-5, the C-terminus of the Cas12a domain may be linked to the N-terminus of the UGI domain via any one of the amino acid sequences of SEQ ID NOs:6-12, the N-terminus of the cytosine deaminase domain may be linked to the C-terminus of the UGI domain via any one of the amino acid sequences of SEQ ID NOs:13-16, the N-terminus of the Cas12a domain may be linked to the C-terminus of the UGI domain via any one of the amino acid sequences of SEQ ID NOs:17-19, and/or the N-terminus of the cytosine deaminase domain may be linked to the C-terminus of the Cas12a domain via any one of the amino acid sequences of SEQ ID NOs:20-24. In some embodiments, when the N-terminus of the Cas12a domain is linked to the C-terminus of the cytosine deaminase domain via any one of the amino acid sequences of SEQ ID NOs:1-5, the C-terminus of the Cas12a domain may be linked to the UGI domain via GS linker. In some embodiments, when the C-terminus of the Cas12a domain is linked to the N-terminus of the UGI domain via any one of the amino acid sequences of SEQ ID NOs:6-12, the N-terminus of the Cas12a domain may be linked to the cytosine domain via a GS linker. In some embodiments, when the N-terminus of the Cas12a domain is linked to the C-terminus of the UGI domain via any one of the amino acid sequences of SEQ ID NOs:17-19, the C-terminus of the Cas12a may be linked to the cytosine deaminase via a GS linker. In some embodiments, when the N-terminus of the cytosine deaminase domain is linked to the C-terminus of the Cas12a domain via any one of the amino acid sequences of SEQ ID NOs:20-24, the C-terminus of the Cas12a is linked to the cytosine deaminase via a GS linker. Example fusion proteins of the present invention include, but are not limited to, the amino acid sequences of SEQ ID NO:49-72.

In some embodiments, a fusion protein is provided comprising: (a) a cytosine deaminase domain; (b) a Cas12a domain; and (c) a uracil DNA glycosylase inhibitor (UGI) domain, wherein the C-terminus of the cytosine deaminase domain is linked to the N-terminus of the Cas12a domain via any one of the amino acid sequences of SEQ ID NOs:1-5 and the C-terminus of the Cas12a domain is linked to the N-terminus of the UGI domain, or the C-terminus of the Cas12a domain is linked to the N-terminus of the UGI domain via any one of the amino acid sequences of SEQ ID NOs:6-9 and the C-terminus of the cytosine deaminase domain is linked to the N-terminus of the Cas12a domain. In some embodiments, C-terminus of the Cas12a domain may be linked to the N-terminus of the UGI domain via GS linker. In some embodiments, and the C-terminus of the cytosine deaminase domain is linked to the N-terminus of the Cas12a domain via a GS linker. In some embodiments, the C-terminus of the cytosine deaminase domain is linked to the N-terminus of the Cas12a domain via the amino acid sequence of SEQ ID NO:29. Example fusion proteins of the invention include, but are not limited to, any one of the amino acid sequences of SEQ ID NOs:64-72.

In some embodiments, a fusion protein is provided comprising: a) a Cas12a (Cpf1) domain; (b) a uracil DNA glycosylase inhibitor (UGI) domain; and (c) a cytosine deaminase domain, wherein the C-terminus of the Cas12a domain is linked to the N-terminus of the UGI domain via any one of the amino acid sequences of SEQ ID NOs:10-12 and the C-terminus of the UGI domain is linked to the N-terminus of the cytosine deaminase domain via any one of the amino acid sequences of SEQ ID NOs:13-16, wherein the amino acid sequences of SEQ ID NOs:10-12 and the amino acid sequences of SEQ ID NOs:13-16 are independently selected. Example fusion proteins of the invention include, but are not limited to, any one of the amino acid sequences of SEQ ID NOs:58-63.

In some embodiments, a fusion protein is provided comprising: (a) a uracil DNA glycosylase inhibitor (UGI) domain; (b) a Cas12a (Cpf1) domain, wherein the Cas12a domain comprises a mutation in the nuclease active site; and (c) a cytosine deaminase domain, wherein the C-terminus of the UGI domain is linked to the N-terminus of the Cas12a domain via any one of the amino acid sequences of SEQ ID NOs:17-19 and the C-terminus of the Cas12a domain is linked to the N-terminus of the cytosine deaminase domain, or wherein the C-terminus of the UGI domain is linked to the N-terminus of the Cas12a domain and the C-terminus of the Cas12a domain is linked to the N-terminus of the cytosine deaminase domain via any one of the amino acid sequences of SEQ ID NOs:20-24. In some embodiments, the C-terminus of the Cas12a domain is linked to the N-terminus of the cytosine deaminase domain via GS linker. In some embodiments, the C-terminus of the Cas12a domain is linked to the N-terminus of the cytosine deaminase domain via the amino acid sequence of SEQ ID NO:28. In some embodiments, the C-terminus of the UGI domain is linked to the N-terminus of the Cas12a domain via a GS linker. Example fusion proteins of the invention include, but are not limited to, any one of the amino acid sequences of SEQ ID NOs:49-72.

A cytosine deaminase (or cytidine deaminase) useful with this invention may be any known or later identified cytosine deaminase from any organism (see, e.g., U.S. Pat. No. 10,167,457 and Thuronyi et al. *Nat. Biotechnol.* 37:1070-1079 (2019), each of which is incorporated by reference herein for its disclosure of cytosine deaminases). Cytosine deaminases can catalyze the hydrolytic deamination of cytidine or deoxycytidine to uridine or deoxyuridine, respectively. In some embodiments, the deaminase polypeptide or deaminase domain is a cytidine deaminase domain, catalyzing the hydrolytic deamination of cytosine to uracil. In some embodiments, a cytosine deaminase may be a variant of a naturally-occurring cytosine deaminase, including but not limited to a primate (e.g., a human, monkey, chimpanzee, gorilla), a dog, a cow, a rat or a mouse. Thus, in some embodiments, an cytosine deaminase useful with the invention may be about 70% to 100% identical to a wild type cytosine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, and any range or value therein, to a naturally occurring cytosine deaminase). In some embodiments, a polynucleotide encoding a cytosine deaminase polypeptide/domain may be codon optimized for expression in an organism.

In some embodiments, a cytosine deaminase useful with the invention may be an apolipoprotein B mRNA-editing complex (APOBEC) family deaminase. In some embodiments, the cytosine deaminase may be an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, an APOBEC3H deaminase, an APOBEC4 deaminase, a human activation induced deaminase (hAID), an rAPOBEC1, FERNY, and/or a CDA1, optionally a pmCDA1, an atCDA1 (e.g., At2g19570), and/or evolved versions of the same. In some embodiments, the cytosine deaminase may be an APOBEC1 deaminase having the amino acid sequence of SEQ ID NO:46. In some embodiments, the cytosine deaminase may be an APOBEC3A deaminase having the amino acid sequence of SEQ ID NO:47. In some embodiments, a cytosine deaminase useful with the invention may be about 70% to 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical) to the amino acid sequence of a naturally occurring cytosine deaminase. In some embodiments, a cytosine deaminase useful with the invention may be about 70% to 99.5% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 99.5% identical) to the amino acid sequence of SEQ ID NO:46 or SEQ ID NO:47 (e.g., at least 80%, at least 85%, at least 90%, at least 92%, at least 95%, at least 96%, at least 97%, at least 98%, at least 99%, or at least 99.5% identical to the amino acid sequence of SEQ ID NO:46 or SEQ ID NO:47). In some embodiments, a polynucleotide encoding a cytosine deaminase may be codon optimized for expression in an organism and the codon optimized polypeptide may be about 70% to 99.5% identical to the reference polynucleotide.

A "uracil glycosylase inhibitor" useful with the invention may be any protein that is capable of inhibiting a uracil-DNA glycosylase base-excision repair enzyme. In some embodiments, a UGI domain comprises a wild-type UGI or a fragment thereof. In some embodiments, a UGI domain useful with the invention may be about 70% to 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical and any range or value therein) to the amino acid sequence of a naturally occurring UGI domain. In some embodiments, a UGI domain may comprise the amino acid sequence of SEQ ID NO: 48 or a polypeptide having about 70% to 99.5% identity to the amino acid sequence of SEQ ID NO: 48 (e.g., at least 80%, at least 85%, at least 90%, at least 92%, at least 95%, at least 96%, at least 97%, at least 98%, at least 99%, or at least 99.5% identical to the amino acid sequence of SEQ ID NO:48). For example, in some embodiments, a UGI domain may comprise a fragment of the amino acid sequence of SEQ ID NO:48 that is 100% identical to a portion of consecutive nucleotides (e.g., 10, 15, 20, 25, 30, 35, 40, 45, 50, 55, 60, 65, 70, 75, 80 consecutive nucleotides; e.g., about 10, 15, 20, 25, 30, 35, 40, 45, to about 50, 55, 60, 65, 70, 75, 80 consecutive nucleotides) of the amino acid sequence of SEQ ID NO:48. In some embodiments, a UGI domain may be a variant of a known UGI (e.g., SEQ ID NO:48) having 70% to 99.5% identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% identity, and any range or value therein) to the known UGI. In some embodiments, a polynucleotide encoding a UGI may be codon optimized for expression in an organism and the codon optimized polypeptide may be about 70% to 99.5% identical to the reference polynucleotide.

Fusion proteins of the invention comprising a Cas12a domain linked to a polypeptide of interest as described herein may be used in combination with a guide RNA (gRNA, CRISPR array, CRISPR RNA, crRNA), designed to function with a Cas12a domain, to modify a target nucleic acid. A guide nucleic acid (CRISPR RNA, CRISPR DNA, crRNA, crDNA) useful with this invention comprises a spacer sequence and a repeat sequence. The guide nucleic acid is capable of forming a complex with the Cas12a domain of the fusion protein and the spacer sequence is capable of hybridizing to a target nucleic acid, thereby guiding the Cas12a domain and the polypeptide of interest to the target nucleic acid, wherein the target nucleic acid is modified (e.g., cleaving or editing) or modulated (e.g., modulating transcription) by the polypeptide of interest of the fusion protein. As an example, a fusion protein comprising a Cas12a domain linked to a cytosine deaminase domain as described herein may be used in combination with a Cas12a guide nucleic acid to modify a target nucleic acid, wherein the cytosine deaminase domain of the fusion protein deaminates a cytosine base in the target nucleic acid, thereby editing the target nucleic acid.

A "guide nucleic acid," "guide RNA," "gRNA," "CRISPR RNA/DNA" "crRNA" or "crDNA" as used herein means a nucleic acid that comprises at least one spacer sequence, which is complementary to (and hybridizes to) a target DNA (e.g., protospacer), and at least one repeat sequence (e.g., a repeat of a Type V Cas12a CRISPR-Cas system, or a fragment or portion thereof), wherein the repeat sequence is linked to the 5' end of the spacer sequence. The design of a gRNA of this invention is based on Type V Cas12a CRISPR-Cas systems. In some embodiments, a gRNA for a Cas12a may comprise, from 5' to 3', a repeat sequence (full length or portion thereof ("handle"); e.g., pseudoknot-like structure) and a spacer sequence. In some embodiments, a guide nucleic acid may comprise more than one repeat sequence-spacer sequence (e.g., 2, 3, 4, 5, 6, 7, 8, 9, 10, or more repeat-spacer sequences) (e.g., repeat-spacer-repeat; e.g., repeat-spacer-repeat-spacer-repeat-spacer-repeat-spacer-repeat-spacer, and the like). The guide nucleic acids of this invention are synthetic, human-made and not found in nature. A gRNA can be quite long and may be used as an aptamer (such as in MS2 recruitment strategy) or other RNA structures hanging off the spacer.

A "repeat sequence" as used herein, refers to, for example, any repeat sequence of a wild-type CRISPR Cas12a locus or a repeat sequence of a synthetic crRNA. A repeat sequence useful with this invention can be any known or later identified repeat sequence of a CRISPR Cas12a locus (Type V) or it can be a synthetic repeat designed to function in a Type V CRISPR-Cas system. A repeat sequence may comprise a hairpin structure and/or a stem loop structure. In some embodiments, a repeat sequence may form a pseudoknot-like structure at its 5' end (i.e., "handle"). Thus, in some embodiments, a repeat sequence can be identical to or substantially identical (e.g., at least 70% identical) to a repeat sequence from wild-type Type V CRISPR loci. A repeat sequence from a wild-type Cas12a (Type V) CRISPR locus may be determined through established algorithms, such as using the CRISPRfinder offered through CRISPRdb (see, Grissa et al. *Nucleic Acids Res.* 35 (Web Server issue):W52-7). In some embodiments, a repeat sequence or portion thereof is linked to the 5' end of a spacer sequence, thereby forming a repeat-spacer sequence (e.g., guide RNA, crRNA).

In some embodiments, a repeat sequence comprises, consists essentially of, or consists of at least 10 nucleotides depending on the particular repeat and whether the guide RNA comprising the repeat is processed or unprocessed (e.g., about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 to 100 or more nucleotides, or any range or value therein). In some embodiments, a repeat sequence comprises, consists essentially of, or consists of about 10 to about 20, about 10 to about 30, about 10 to about 45, about 10 to about 50, about 15 to about 30, about 15 to about 40, about 15 to about 45, about 15 to about 50, about 20 to about 30, about 20 to about 40, about 20 to about 50, about 30 to about 40, about 40 to about 80, about 50 to about 100 or more nucleotides.

A repeat sequence linked to the 5' end of a spacer sequence can comprise a portion of a repeat sequence (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more contiguous nucleotides of a wild type repeat sequence). In some embodiments, a portion of a repeat sequence linked to the 5' end of a spacer sequence can be about five to about ten consecutive nucleotides in length (e.g., about 5, 6, 7, 8, 9, 10 nucleotides) and have at least 90% identity (e.g., at least about 90%, 91%, 92%, 93%, 94%, 95%, 96%, 97%, 98%, 99%, or more) to the same region (e.g., 5' end) of a wild type Cas12a repeat nucleotide sequence. In some embodiments, a portion of a repeat sequence comprises a pseudoknot-like structure at its 5' end (e.g., "handle").

A "spacer sequence" as used herein is a nucleotide sequence that is complementary to a target nucleic acid (e.g., target DNA) (e.g, protospacer). The spacer sequence can be fully complementary or substantially complementary (e.g., at least about 70% complementary (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a target nucleic acid. Thus, in some embodiments, the spacer sequence can have one, two, three, four, or five mismatches as compared to the target nucleic acid, which mismatches can be contiguous or noncontiguous. In some embodiments, the spacer sequence can have 70% complementarity to a target nucleic acid. In other embodiments, the spacer nucleotide sequence can have 80% complementarity to a target nucleic acid. In still other embodiments, the spacer nucleotide sequence can have 85%, 90%, 95%, 96%, 97%, 98%, 99% or 99.5% complementarity, and the like, to the target nucleic acid (protospacer). In some embodiments, the spacer sequence is 100% complementary to the target nucleic acid. A spacer sequence may have a length from about 15 nucleotides to about 30 nucleotides (e.g., 15, 16, 17, 18, 19, 20, 21, 22, 23, 24, 25, 26, 27, 28, 29, or 30 nucleotides, or any range or value therein). Thus, in some embodiments, a spacer sequence may have complete complementarity or substantial complementarity over a region of a target nucleic acid (e.g., protospacer) that is at least about 15 nucleotides to about 30 nucleotides in length. In some embodiments, the spacer is about 20 nucleotides in length. In some embodiments, the spacer is about 23 nucleotides in length.

In some embodiments, the 5' region of a spacer sequence of a guide RNA may be identical to a target DNA, while the 3' region of the spacer may be substantially identical to the target DNA and therefore, the overall complementarity of the spacer sequence to the target DNA may be less than 100%. Thus, for example, the first 1, 2, 3, 4, 5, 6, 7, 8, and the like, nucleotides in the 5' region of, for example, a 20 nucleotide spacer sequence (i.e., seed region) may be 100% complementary to the target DNA, while the remaining nucleotides in the 3' region of the spacer sequence are substantially complementary (e.g., at least about 70% complementary) to the target DNA. In some embodiments, the first 1 to 8 nucleotides (e.g., the first 1, 2, 3, 4, 5, 6, 7, 8, nucleotides, and any range therein) of the 5' end of the spacer sequence may be 100% complementary to the target DNA, while the remaining nucleotides in the 3' region of the spacer sequence are substantially complementary (e.g., at least about 50% complementary (e.g., 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to the target DNA. In some embodiments, the seed region of a spacer may be about 5 to 6 nucleotides in length. In some embodiments, the seed region of a spacer is 5 nucleotides in length. In some embodiments, the seed region of a spacer is 6 nucleotides in length.

As used herein, a "target nucleic acid", "target DNA," "target nucleotide sequence," "target region," or a "target region in the genome" refers to a region of an organism's genome that is fully complementary (100% complementary) or substantially complementary (e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a spacer sequence in a guide RNA of this invention. A target region useful for a CRISPR-Cas12a system is located immediately 3' to a PAM sequence in the genome of the organism. A target region may be selected from any at least 15 consecutive nucleotides (e.g., 16, 17, 18, 19, 20, 21, 22, 23, 24, 25, 26, 27, 28, 29, 30 nucleotides, and the like) located immediately adjacent to a PAM sequence.

A "protospacer sequence" refers to the target double stranded DNA and specifically to the portion of the target DNA (e.g., or target region in the genome) that is fully or substantially complementary (and hybridizes) to the spacer sequence of the CRISPR repeat-spacer sequences (e.g., guide RNAs, CRISPR arrays, crRNAs). In the case of Type V CRISPR-Cas Cas12a systems, the protospacer sequence is flanked (immediately adjacent to) a protospacer adjacent motif (PAM). The PAM is located at the 5' end on the non-target strand and at the 3' end of the target strand (see below, as an example).

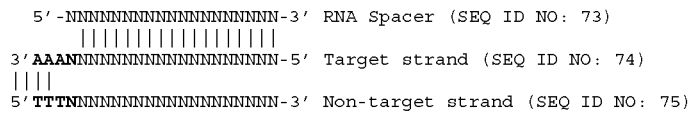

Canonical Cas12a PAMs are T rich. In some embodiments, a canonical Cas12a PAM sequence may be 5'-TTN, 5'-TTTN, or 5'-TTTV. In some embodiments, non-canonical PAMs may be used but may be less efficient.

Additional PAM sequences may be determined by those skilled in the art through established experimental and computational approaches. Thus, for example, experimental approaches include targeting a sequence flanked by all possible nucleotide sequences and identifying sequence members that do not undergo targeting, such as through the transformation of target plasmid DNA (Esvelt et al. 2013. *Nat. Methods* 10:1116-1121; Jiang et al. 2013. *Nat. Biotechnol.* 31:233-239). In some aspects, a computational approach can include performing BLAST searches of natural spacers to identify the original target DNA sequences in bacteriophages or plasmids and aligning these sequences to determine conserved sequences adjacent to the target sequence (Briner and Barrangou. 2014. *Appl. Environ. Microbiol.* 80:994-1001; Mojica et al. 2009. *Microbiology* 155:733-740).

In some embodiments, complexes and compositions are provided, which comprise one or more (e.g., 1, 2, 3, 4, 5, 6, 7, 8, or more) fusion proteins of the present invention and one or more (e.g., 1, 2, 3, 4, 5, 6, 7, 8, or more) guide nucleic acids (e.g., CRISPR RNA/DNA, e.g., crRNA/crDNA). In some embodiments, polynucleotides or nucleic acid constructs are provided that encode the polypeptides, fusion proteins, guide nucleic acids, and/or complexes of the invention. In some embodiments, nucleic acid constructs, expression cassettes and/or vectors comprising the polynucleotides of the invention and/or one or more guide nucleic acids are provided. In some embodiments, a polynucleotide encoding a fusion protein of the invention may be encoded on the same or on a separate polynucleotide, nucleic acid construct, expression cassette or vector from that comprising the guide nucleic acid. When the fusion protein is encoded on a separate polynucleotide, nucleic acid construct, expression cassette or vector from that comprising the guide nucleic acid, the polynucleotide, nucleic acid construct, expression cassette or vector encoding the fusion protein of the invention may be provided (e.g., contacted with a target nucleic acid) prior to, concurrently with, or after the guide nucleic acid is provided (e.g., contacted with the target nucleic acid).

In some embodiments, polynucleotides, nucleic acid constructs, expression cassettes and/or vectors of the invention may be codon optimized for expression in an organism. In some embodiments, an optimized polynucleotide, nucleic acid construct, or expression cassette of the invention may be about 70% to 100% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to the polynucleotides, nucleic acid constructs or expression cassettes encoding the polypeptides, fusion proteins and complexes of the invention.

In some embodiments, a cell comprising one or more polynucleotides, guide nucleic acids, nucleic acid constructs, expression cassettes or vectors of the invention is provided.

The polypeptides, fusion proteins, guide RNAs, complexes, and compositions of the invention and polynucleotides/nucleic acid constructs/expression cassettes/vectors encoding the same may be used for modifying target nucleic acids and/or their expression.

In some embodiments, the fusion protein of the invention is a cytosine base editor (ABE) for use in base editing a target nucleic acid, wherein the fusion protein comprises a Cas12 a domain linked to a cytosine deaminase domain.

In some embodiments, a method of modifying a target nucleic acid is provided, the method comprising contacting the target nucleic acid with: (a)(i) a fusion protein of the invention, and (a)(ii) a guide nucleic acid (e.g., CRISPR RNA, CRISPR DNA, crRNA, crDNA); (b) a complex comprising the fusion protein of the invention and a guide nucleic acid; (c) a composition comprising a fusion protein of the invention and a guide nucleic acid; and/or (d) a system of the invention, thereby modifying a target nucleic acid. A target nucleic acid may be contacted with the fusion protein prior to, concurrently with or after contacting the target nucleic acid with the guide nucleic acid.

In some embodiments, a method of modifying a target nucleic acid is provided, the method comprising contacting the target nucleic acid with a fusion protein comprising any one of the amino acid sequences of SEQ ID NO:49-72 and a guide nucleic acid. A target nucleic acid may be contacted with a fusion protein of the invention prior to, concurrently with or after contacting the target nucleic acid with the guide nucleic acid.

In some embodiments, a method of modifying a target nucleic acid is provided, the method comprising contacting a cell or a cell free system comprising the target nucleic acid with: (a)(i) a polynucleotide encoding a polypeptide of the invention, or a fusion protein of the invention, or an expression cassette or vector comprising the same, and (a)(ii) a guide nucleic acid, and/or an expression cassette or vector comprising the same; and/or (b) a nucleic acid construct encoding a complex comprising a fusion protein of the invention and a guide nucleic acid, and/or an expression cassette or vector comprising the same under conditions wherein the fusion protein is expressed and forms a complex with the guide nucleic acid, the complex hybridizing to the target nucleic acid, thereby modifying the target nucleic acid. When provided on separate constructs, the target nucleic acid may be contacted with the polynucleotide, nucleic acid construct, expression cassette or vector encoding the fusion protein prior to, concurrently with or after contacting the target nucleic acid with the guide nucleic acid.

In some embodiments, a method of modifying a target nucleic acid is provided, the method comprising contacting a cell or a cell free system comprising the target nucleic acid with a polynucleotide encoding a fusion protein comprising any one of the amino acid sequences of SEQ ID NO:50-78, or an expression cassette or vector comprising the same and a guide nucleic acid, or an expression cassette or vector comprising the same under conditions wherein the fusion protein is expressed and forms a complex with the guide nucleic acid, the complex hybridizing to the target nucleic acid, thereby modifying the target nucleic acid. When provided on separate constructs, the target nucleic acid may be contacted with the polynucleotide, nucleic acid construct, expression cassette or vector encoding the fusion protein prior to, concurrently with or after contacting the target nucleic acid with the guide nucleic acid.

In some embodiments, the present invention provides a method of editing a target nucleic acid, the method comprising contacting the target nucleic acid with: (a)(i) a fusion protein of the invention, and (a)(ii) a guide nucleic acid; (b) a complex comprising a fusion protein of the invention and guide nucleic acid; (c) a composition comprising (i) a fusion protein of the invention and (ii) a guide nucleic acid; and/or (d)(i) a CRISPR-Cas system of the invention, wherein the cytosine deaminase domain converts a cytosine (C) to a thiamine (T) in the target nucleic acid, thereby editing the target nucleic acid to produce a (point) mutation. A target nucleic acid may be contacted with a fusion protein of the invention prior to, concurrently with or after contacting the target nucleic acid with the guide nucleic acid.

In some embodiments, a method of editing a target nucleic acid is provided, the method comprising contacting the target nucleic acid with a fusion protein comprising any one of the amino acid sequences of SEQ ID NO:49-72 and a guide nucleic acid, thereby editing the target nucleic acid. The target nucleic acid may be contacted with a fusion protein of the invention prior to, concurrently with or after contacting the target nucleic acid with the guide nucleic acid.

In some embodiments, a method of editing a target nucleic acid is provided, the method comprising contacting a cell or a cell free system comprising the target nucleic acid with: (a)(i) a polynucleotide encoding a fusion protein of the invention, and/or an expression cassette or vector comprising the same, and (a)(ii) a guide nucleic acid, and/or an expression cassette or vector comprising (a)(i) and/or (a)(ii); and/or (b) a nucleic acid construct encoding a complex comprising a fusion protein of the invention and a guide nucleic acid, or an expression cassette or vector comprising the same under conditions wherein the fusion protein is expressed and forms a complex with the guide nucleic acid, the complex hybridizing to the target nucleic acid, wherein the cytosine deaminase domain converts a cytosine (C) to a thiamine (T) in the target nucleic acid, thereby editing the target nucleic acid to produce a (point) mutation. When provided on separate constructs, the target nucleic acid may be contacted with the fusion protein prior to, concurrently with or after contacting the target nucleic acid with the guide nucleic acid.

In some embodiments, a method of editing a target nucleic acid is provided, the method comprising contacting a cell or a cell free system comprising the target nucleic acid with a polynucleotide encoding a fusion protein comprising any one of the amino acid sequences of SEQ ID NOs:49-72 or an expression cassette or vector comprising the same and a guide nucleic acid, or an expression cassette or vector comprising the same under conditions wherein the fusion protein is expressed and forms a complex with the guide nucleic acid, the complex hybridizing to the target nucleic acid, thereby editing the target nucleic acid. The polynucleotide encoding the fusion protein comprising any one of the amino acid sequences of SEQ ID NOs:49-72 may be present on the same expression cassette or vector that comprises the guide nucleic acid. When the polynucleotide encoding the fusion protein comprising any one of the amino acid sequences of SEQ ID NOs:49-72 is on a separate expression cassette or vector from that comprising the guide nucleic acid, the target nucleic acid may be contacted with the expression cassette/vector comprising the fusion protein prior to, concurrently with or after contacting the target nucleic acid with the expression cassette/vector comprising the guide nucleic acid.

In some embodiments, the present invention provides a method of editing a target domain/polypeptide useful for base editing may be used with this invention. A "cytosine deaminase" and "cytidine deaminase" as used herein refer to a polypeptide or domain thereof that catalyzes or is capable of catalyzing cytosine deamination in that the polypeptide or domain catalyzes or is capable of catalyzing the removal of an amine group from a cytosine base. Thus, a cytosine deaminase may result in conversion of cystosine to a thymidine (through a uracil intermediate), causing a C to T conversion, or a G to A conversion in the complementary strand in the genome. Thus, in some embodiments, the cytosine deaminase encoded by the polynucleotide of the invention generates a C→T conversion in the sense (e.g., "+"; template) strand of the target nucleic acid or a G→A conversion in antisense (e.g., "−", complementary) strand of the target nucleic acid. In some embodiments, a cytosine deaminase encoded by a polynucleotide of the invention generates a C to T, G, or A conversion in the complementary strand in the genome.

A cytosine deaminase useful with this invention may be any known or later identified cytosine deaminase from any organism (see, e.g., U.S. Pat. No. 10,167,457 and Thuronyi et al. *Nat. Biotechnol.* 37:1070-1079 (2019), each of which is incorporated by reference herein for its disclosure of cytosine deaminases). Cytosine deaminases can catalyze the hydrolytic deamination of cytidine or deoxycytidine to uridine or deoxyuridine, respectively. Thus, in some embodiments, a deaminase or deaminase domain useful with this invention may be a cytidine deaminase domain, catalyzing the hydrolytic deamination of cytosine to uracil. In some embodiments, a cytosine deaminase may be a variant of a naturally-occurring cytosine deaminase, including, but not limited to, a primate (e.g., a human, monkey, chimpanzee, gorilla), a dog, a cow, a rat or a mouse. Thus, in some embodiments, an cytosine deaminase useful with the invention may be about 70% to about 100% identical to a wild type cytosine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, and any range or value therein, to a naturally occurring cytosine deaminase).

In some embodiments, a cytosine deaminase useful with the invention may be an apolipoprotein B mRNA-editing complex (APOBEC) family deaminase. In some embodiments, the cytosine deaminase may be an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, an APOBEC3H deaminase, an APOBEC4 deaminase, a human activation induced deaminase (hAID), an rAPOBEC1, FERNY, and/or a CDA1, optionally a pmCDA1, an atCDA1 (e.g., At2g19570), and evolved versions of the same. In some embodiments, the cytosine deaminase may be an APOBEC1 deaminase, optionally having the amino acid sequence of SEQ ID NO:46 or SEQ ID NO:79. In some embodiments, the cytosine deaminase may be an APOBEC3A deaminase, optionally having the amino acid sequence of SEQ ID NO:47. In some embodiments, the cytosine deaminase may be an CDA1 deaminase, optionally a CDA1 having the amino acid sequence of SEQ ID NO:76. In some embodiments, the cytosine deaminase may be a FERNY deaminase, optionally a FERNY having the amino acid sequence of SEQ ID NO:77 or SEQ ID NO:80. In some embodiments, the cytosine deaminase may be a hAID deaminase, optionally a hAID having the amino acid sequence of SEQ ID NO:81 or SEQ ID NO:82. In some embodiments, a cytosine deaminase useful with the invention may be about 70% to about 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical) to the amino acid sequence of a naturally occurring cytosine deaminase (e.g., "evolved deaminases") (see, e.g., SEQ ID NO:78, SEQ ID NO:79, SEQ ID NO:80, SEQ ID NO:82). In some embodiments, a cytosine deaminase useful with the invention may be about 70% to about 99.5% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 99.5% identical) to the amino acid sequence of SEQ ID NO:46, SEQ ID NO:47, SEQ ID NO:76, SEQ ID NO:77, SEQ ID NO:78, SEQ ID NO:79, SEQ ID NO:80, SEQ ID NO:81, or SEQ ID NO:82 (e.g., at least 80%, at least 85%, at least 90%, at least 92%, at least 95%, at least 96%, at least 97%, at least 98%, at least 99%, or at least 99.5% identical to the amino acid sequence of SEQ ID NO:46, SEQ ID NO:47, SEQ ID NO:76, SEQ ID NO:77, SEQ ID NO:78, SEQ ID NO:79, SEQ ID NO:80, SEQ ID NO:81, or SEQ ID NO:82). In some embodiments, a polynucleotide encoding a cytosine deaminase may be codon optimized for expression in a plant and the codon optimized polypeptide may be about 70% to 99.5% identical to the reference polynucleotide.

The fusion proteins of the invention and polypeptides and nucleic acid constructs encoding the same may be used in combination with guide nucleic acids for modifying target nucleic acid including, but not limited to, generation of C→T or G→A mutations in a target nucleic acid including, but not limited to, a plasmid sequence; generation of C→T or G→A mutations in a coding sequence to alter an amino acid identity; generation of C→T or G→A mutations in a coding sequence to generate a stop codon; generation of C→T or G→A mutations in a coding sequence to disrupt a start codon; generation of point mutations in genomic DNA to disrupt transcription factor binding; generation of point mutations in genomic DNA to disrupt splice junctions; and/or other nucleic acid modifications generated by a fusion protein comprising a Cas12a domain fused to other domains (polypeptides of interest) via any one of the amino acid sequences SEQ ID NOs:1-24 (e.g., peptide linkers).

The fusion proteins of the invention and polypeptides and nucleic acid constructs encoding the same may be useful for modifying the target nucleic acid of any organism, including but not limited to, an animal, a plant, a fungus, an archaeon, or a bacterium. An animal can include, but is not limited to, a mammal, an insect, a fish, a bird, and the like.

Exemplary mammals for which this invention may be useful include, but are not limited to, primates (human and non-human (e.g., a chimpanzee, baboon, monkey, gorilla, etc.)), cats, dogs, mice, rats, ferrets, gerbils, hamsters, cows, pigs, horses, goats, donkeys, or sheep.

The target nucleic acid of any plant or plant part may be modified using the fusion proteins of the invention and polypeptides and nucleic acid constructs encoding the same. Any plant (or groupings of plants, for example, into a genus or higher order classification) can be employed in practicing this invention including an angiosperm, a gymnosperm, a monocot, a dicot, a C3, C4, CAM plant, a bryophyte, a fern and/or fern ally, a microalgae, and/or a macroalgae. A plant and/or plant part useful with this invention may be a plant and/or plant part of any plant species/variety/cultivar. The term "plant part," as used herein, includes but is not limited to, embryos, pollen, ovules, seeds, leaves, stems, shoots, flowers, branches, fruit, kernels, ears, cobs, husks, stalks, roots, root tips, anthers, plant cells including plant cells that are intact in plants and/or parts of plants, plant protoplasts, plant tissues, plant cell tissue cultures, plant calli, plant clumps, and the like. As used herein, "shoot" refers to the above ground parts including the leaves and stems. Further, as used herein, "plant cell" refers to a structural and physiological unit of the plant, which comprises a cell wall and also may refer to a protoplast. A plant cell can be in the form of an isolated single cell or can be a cultured cell or can be a part of a higher-organized unit such as, for example, a plant tissue or a plant organ.

The fusion proteins of the invention and polypeptides and nucleic acid constructs encoding the same may be used to modify (e.g., base edit, cleave, nick etc) the target nucleic acid of any plant or plant part. Non-limiting examples of plants useful with the present invention include turf grasses (e.g., bluegrass, bentgrass, ryegrass, fescue), feather reed grass, tufted hair grass, miscanthus, arundo, switchgrass, vegetable crops, including artichokes, kohlrabi, arugula, leeks, asparagus, lettuce (e.g., head, leaf, romaine), malanga, melons (e.g., muskmelon, watermelon, crenshaw, honeydew, cantaloupe), cole crops (e.g., brussels sprouts, cabbage, cauliflower, broccoli, collards, kale, chinese cabbage, bok choy), cardoni, carrots, napa, okra, onions, celery, parsley, chick peas, parsnips, chicory, peppers, potatoes, cucurbits (e.g., marrow, cucumber, zucchini, squash, pumpkin, honeydew melon, watermelon, cantaloupe), radishes, dry bulb onions, rutabaga, eggplant, salsify, escarole, shallots, endive, garlic, spinach, green onions, squash, greens, beet (sugar beet and fodder beet), sweet potatoes, chard, horseradish, tomatoes, turnips, and spices; a fruit crop such as apples, apricots, cherries, nectarines, peaches, pears, plums, prunes, cherry, quince, fig, nuts (e.g., chestnuts, pecans, pistachios, hazelnuts, pistachios, peanuts, walnuts, macadamia nuts, almonds, and the like), citrus (e.g., clementine, kumquat, orange, grapefruit, tangerine, mandarin, lemon, lime, and the like), blueberries, black raspberries, boysenberries, cranberries, currants, gooseberries, loganberries, raspberries, strawberries, blackberries, grapes (wine and table), avocados, bananas, kiwi, persimmons, pomegranate, pineapple, tropical fruits, pomes, melon, mango, papaya, and lychee, a field crop plant such as clover, alfalfa, timothy, evening primrose, meadow foam, corn/maize (field, sweet, popcorn), hops, jojoba, buckwheat, safflower, quinoa, wheat, rice, barley, rye, millet, sorghum, oats, triticale, sorghum, tobacco, kapok, a leguminous plant (beans (e.g., green and dried), lentils, peas, soybeans), an oil plant (rape, canola, mustard, poppy, olive, sunflower, coconut, castor oil plant, cocoa bean, groundnut, oil palm), duckweed, *Arabidopsis*, a fiber plant (cotton, flax, hemp, jute), Cannabis (e.g., *Cannabis sativa, Cannabis* indica, and *Cannabis ruderalis*), lauraceae (cinnamon, camphor), or a plant such as coffee, sugar cane, tea, and natural rubber plants; and/or a bedding plant such as a flowering plant, a cactus, a succulent and/or an ornamental plant (e.g., roses, tulips, violets), as well as trees such as forest trees (broad-leaved trees and evergreens, such as conifers; e.g., elm, ash, oak, maple, fir, spruce, cedar, pine, birch, cypress, eucalyptus, willow), as well as shrubs and other nursery stock. In some embodiments, the fusion proteins of the invention and polypeptides and nucleic acid constructs encoding the same may be used to modify maize, soy, wheat, canola, rice, tomato, pepper, sunflower, raspberry, blackberry, black raspberry and/or cherry.

The present invention further comprises a kit or kits to carry out the methods of this invention. A kit of this invention can comprise reagents, buffers, and apparatus for mixing, measuring, sorting, labeling, etc., as well as instructions and the like as would be appropriate for modifying a target nucleic acid.

In some embodiments, the invention provides a kit comprising one or more polypeptides of the invention, one or more fusion proteins of the invention, one or more polynucleotides encoding one or more fusion proteins of the invention, a CRISPR-Cas system of the invention, and/or expression cassettes or vectors comprising the same, with optional instructions for the use thereof. In some embodiments, a kit may further comprise a Cas12a guide nucleic acid and/or expression cassette or vector comprising the same. In some embodiments, the guide nucleic acid may be provided on the same expression cassette or vector as a polynucleotide encoding a fusion protein of the invention.

Accordingly, in some embodiments kits are provided comprising a nucleic acid construct comprising (a) polynucleotide encoding a fusion protein as provided herein and (b) a promoter that drives expression of the polynucleotide of (a). In some embodiments, the kit may further comprise a nucleic acid construct encoding a guide nucleic acid, wherein the construct comprises a cloning site for cloning of a nucleic acid sequence identical or complementary to a target nucleic acid sequence into backbone of the guide nucleic acid.

In some embodiments, the polypeptides of the kit may further comprise one or more nuclear localization signals fused to the fusion protein, or a polynucleotide encoding the same. In some embodiments, a polynucleotide of the kit may further encode one or more selectable markers useful for identifying transformants (e.g., a nucleic acid encoding an antibiotic resistance gene, herbicide resistance gene and the like). In some embodiments, the polynucleotide may be an mRNA that may encode one or more introns within the encoded fusion protein.

The invention will now be described with reference to the following examples. It should be appreciated that these examples are not intended to limit the scope of the claims to

EXAMPLES

Example 1

Although some variations of Cas12a-based cytosine base editors have been tested, they have lower activity compared to Cas9-based versions. All of the tested variants used the same set of linkers used in Cas9-based cytosine base editors (GS linkers, the XTEN linker, and the GS-XTEN-GS linker), and none were rationally or computationally optimized using structure-based techniques. Therefore, we sought to develop optimized Cas12a-based cytosine base editors by designing optimal linker lengths and sequences for various domain architectures based on the ideal placement of the rAPOBEC1 and UGI domains.

Initial fusion protein designs used Lachnospiraceae bacterium ND2006 Cas12a (LbCas12a) (e.g., SEQ ID NO:29) due to its lower temperature sensitivity and proven activity in plant cells; however, due to the high level of structural similarity between different Cas12a endonucleases, these designs should extend to Cas12a enzymes from other species (e.g., *Acidaminococcus* sp. Cpf1 (AsCpf1), *Francisella novicida* Cpf1 (FnCpf1) and others, see, e.g., SEQ ID NOs:30-45).

Using a structure-based approach, we have developed several linker sequences designed to enable optimal placement of cytosine deaminase domains relative to Cas12a so that they will be able to access the single-stranded portion of the nontarget strand for base editing. We have also designed linker sequences to ensure that the UGI domain is positioned such that it can bind uracil DNA glycosylase without interfering with the other components of the base editor. Due to the placement of the termini of Cas12a and the orientation of its guide RNA, the ideal linkers for these placements differ significantly from the current state-of-the-art linkers used in the Cas9 CBEs as well as the published versions of Cas12a-based CBEs. These linkers were designed to accommodate several possible base editor domain architectures, linking the deaminase domain to either terminus of Cas12a. Exemplary designed linkers are provided in Table 1.

TABLE 1

Exemplary linkers

| Linker Name | Length | Score per residue | Sequence | SEQ ID NO/ Linker (L) No. |
|---|---|---|---|---|
| ACU_1_1 | 36 | -1.408 | EKSKNDRSKPQPSDDRDRQPPSGEDYPEWKAPGEYE | 1 |
| ACU_1_2 | 34 | -1.359 | QEPKPQDQSSEVPPPPGSQKPGTKEPHDSKSSGP | 2 |
| ACU_1_3 | 34 | -1.332 | PDNSSGQKLQLPQPSDKPQDSREKSDSLPSDKRD | 3 |
| ACU_1_3_R* | 34 | -1.020 | PDNSTLQTLQLPQPTPSSTDTQQTSDTDPEDTTDVI | 4 |
| ACU_1_5R* | 30 | ND | STSQSDGSSVPADIDQSSDSDQSSSQGQPG | 5 |
| ACU_2_1 | 14 | -1.547 | AKPDDESQKPPQDD | 6 |
| ACU_2_2 | 14 | -1.511 | LQLEPGPTTPEYPI | 7 |
| ACU_2_2R* | 14 | -1.351 | IQLPPSDTTPENPI | 8 |
| ACU_2_4 | 12 | ND | ESNDNSQVPPSL | 9 |
| CUA_1_1 | 10 | 1.107 | SEQQEYPGSG | 10 |
| CUA_1_1R* | 10 | -1.115 | NNSEQQENPA | 11 |
| CUA_1_3 | 12 | -1.015 | STDGSGQPKHKP | 12 |
| CUA_2_1 | 20 | -1.174 | PKPSSESGERYEQQPEPPPP | 13 |
| CUA_2_2 | 16 | -1.134 | KGGGGEPDEKRPSQSS | 14 |
| CUA_2_3 | 14 | -1.013 | YAGGTPKEPPPPNS | 15 |
| CUA_2_3R* | 14 | -0.860 | PLVAGGTPFEPPPP | 16 |
| UCA_1_1 | 14 | -1.404 | PQPDERSQIPDNKE | 17 |
| UCA_1_3 | 10 | -1.303 | YTDEKPLPRS | 18 |
| UCA_1_4 | 12 | ND | SHPPQEPPQSNL | 19 |
| UCA_2_1 | 16 | -1.530 | SESPSKQQPEPKSSKG | 20 |
| UCA_2_1R* | 16 | -1.166 | SESPTNQQPEPQWTTD | 21 |
| UCA_2_2 | 16 | -1.398 | GGSKGPPPSPPPPQPE | 22 |

TABLE 1-continued

Exemplary linkers

| Linker Name | Length | Score per residue | Sequence | SEQ ID NO/ Linker (L) No. |
|---|---|---|---|---|
| UCA_2_2R* | 16 | −1.143 | GPLPAPPPQPPPPQPN | 23 |
| UCA_2_3 | 14 | −1.255 | RPLPHDNNKQDYSK | 24 |

To test the effectiveness (including length, flexibility, and susceptibility to proteases) of each designed linker sequence, constructs were generated containing each linker sequence for a particular architecture in a vector for expression in mammalian cells. Domain arrangements of Cas12a-based cytosine base editors selected for experimental screening are provided in FIG. 1A-C and example sequences generated for testing include SEQ ID NOs:49-72).

In the case of the constructs having the domain arrangements as set forth in FIG. 1A and FIG. 1C, the linkers to APOBEC1 and UGI are independent of one another relative to Cas12a; therefore, they were placed in separate constructs and paired with length-matched control linkers (8-residue GS, XTEN, or GS-XTEN-GS). For the domain arrangement as set forth in FIG. 1C, since both linkers potentially affect the position of the deaminase, all combinations of designed linkers are tested. Two previously tested Cas12a cytosine base editor designs were used as controls (FIG. 2).

After screening in mammalian cells, the most effective linkers for each architecture is selected for testing in stable plant transformation (e.g., soybean).

Example 2

HEK293T Cell Testing

HEK293T cells (a human cell line) were seeded into 48-well collagen-coated plates (Corning) in the absence of antibiotic using DMEM (Dulbeeco's Modified Eagle Medium) media. At 70-80% confluency, cells were transfected with 1.5 μL of Lipofectamine 3000 (ThermoFisher Scientific) using 750 ng of base-editor plasmid and 250 ng of guide RNA plasmid according to manufacturer's protocol. After 3 days, cells were lysed, and DNA was extracted using MagMax™ DNA extraction kit (Applied Biosystems).

All constructs listed in Table 1 were tested in a total of four experiments in HEK293T cells as described above. The results for each of the four experiments are provided in Tables 2-5, below and in FIGS. 3-20. Percentages in Tables 2-5 indicate the maximum amount of C→T editing observed at any one base in the spacer indicated.

In FIGS. 3-20, constructs are listed on the X axis, with each bar for a given construct representing editing at a single cytosine within the editing window as described in the figure legend. The Y axis indicates the level of editing observed for each cytosine within the window. The error bars represent standard deviations across multiple experiments for the same construct and guide. Where error bars are not present, only one set of measurements was acquired. Editing efficiencies were not determined for certain constructs and spacers as indicated in the Tables as ND=No Data.

Designed linkers, particularly in the ACU configuration, show improved editing efficiencies relative to control constructs Spacer sequences are as follows:

EMX1 spacer 1:
(SEQ ID NO: 83)
TCATCTGTGCCCCTCCCTCCCTG

RUNX1 spacer 1:
(SEQ ID NO: 84)
AGCCTCACCCCTCTAGCCCTACA

RUNX1 spacer 2:
(SEQ ID NO: 85)
TTCTCCCCTCTGCTGGATACCTC

DNMT1 spacer 1:
(SEQ ID NO: 86)
CCTCACTCCTGCTCGGTGAATTT

DNMT1 spacer 2:
(SEQ ID NO: 87)
GCTCAGCAGGCACCTGCCTCAGC

AAVS1 spacer 1:
(SEQ ID NO: 88)
TCTGTCCCCTCCACCCCACAGTG

TABLE 2

Initial editing results for Cas12a CBE constructs as Apobec1 fusions

| Construct | Peak editing EMX1 Spacer 1 | Peak editing RUNX1 Spacer 1 | Peak editing RUNX1 Spacer 2 | Peak editing DNMT1 Spacer 1 | Peak editing DNMT1 Spacer 2 |
|---|---|---|---|---|---|
| ACU_L1_1 | 0.6% | 1.8% | 2.3% | 2.2% | ND |
| ACU_L1_2 | 1.0% | 2.3% | 2.9% | 3.8% | 0.2% |
| ACU_L1_3 | 0.9% | 1.7% | 3.7% | 3.4% | 0.7% |
| ACU_L1_3R | 0.3% | 1.4% | 0% | 3.6% | 0.3% |
| ACU_L1_5R | 0.9% | 2.2% | 4.0% | 2.8% | 0.2% |
| UCA_L1_4 | 0.3% | 1.3% | 2.0% | 3.1% | 0.1% |
| UCA_L2_1 | 0.8% | 1.9% | ND | 3.9% | 0.2% |
| UCA_L2_1R | 0% | 0% | ND | 0% | 0% |
| UCA_L2_4 | 0% | 0% | ND | 0% | 0% |
| CUA Control | 0.4% | 1.5% | ND | 2.7% | 0.1% |
| Shanghai Tech Control | 0.2% | 0.9% | ND | 1.4% | 0.2% |

TABLE 3

Initial editing results for remaining Cas12a CBE constructs as Apobec1 fusions

| Construct | Peak editing EMX1 | Peak editing RUNX1 Spacer 1 | Peak editing DNMT1 Spacer 1 | Peak editing DNMT1 Spacer 2 |
|---|---|---|---|---|
| ACU_L2_1 | ND | 7.5% | 7.8% | 0.9% |
| ACU_L2_2 | 1.3% | 3.2% | ND | 0.6% |
| ACU_L2_2R | 0.9% | 4.7% | ND | 0.5% |
| ACU_L2_4 | 2.3% | 4.5% | 3.6% | 0.4% |
| CUA_L1_1R_L2_1 | 1.8% | 3.3% | 4.3% | 0.5% |
| CUA_L1_1R_L2_2 | 1.5% | 5.7% | 4.7% | 0.5% |
| CUA_L1_3_L2_2 | 1.6% | 5.2% | 6.5% | 0.8% |
| CUA_L1_3_L2_3R | 2.0% | 4.5% | 6.2% | 0.7% |
| UCA_L1_3 | ND | 3.8% | 4.3% | 0.8% |
| CUA_Control | 1.9% | 4.0% | 5.0% | 0.7% |
| ACU_Control | 3.4% | 6.1% | 4.4% | 0.6% |
| Shanghai Tech Control | 0.3% | 2.6% | 3.9% | 0.4% |

TABLE 4

Replicated editing results for Cas12a CBE constructs.

| Construct | Peak editing EMX1 | Peak editing RUNX1 Spacer 1 | Peak editing RUNX1 Spacer 2 | Peak editing AAVS1 Spacer 1 | Peak editing DNMT1 Spacer 1 |
|---|---|---|---|---|---|
| ACU_L1_1 | 1.7% | 4.9% | ND | 8.3% | 5.4% |
| ACU_L1_2 | 0.9% | 4.3% | ND | 12.5% | 6.7% |
| ACU_L1_3 | 0.7% | 4.0% | ND | 5.8% | 6.8% |
| ACU_L1_3R | 3.3% | 4.2% | ND | 8.8% | 10.5% |
| ACU_L1_5R | 2.5% | 6.9% | ND | 10.3% | 8.8% |
| CUA_L1_3_L2_1 | 1.0% | 3.3% | ND | 3.1% | 4.0% |
| UCA_L1_1 | 1.9% | 3.4% | ND | 5.2% | 5.3% |
| UCA_L1_4 | 2.2% | 0.1% | 4.7% | 2.5% | 5.7% |
| UCA_L2_1 | 0% | 0% | ND | 1.7% | 3.1% |
| UCA_L2_1R | 0.6% | 0% | ND | 5.3% | 4.5% |
| UCA_L2_2 | 1.3% | 0.2% | 3.3% | 12.7% | 5.8% |
| UCA_L2_2R | 0.0% | 0% | 0% | 0.0% | 0.4% |
| UCA_L2_3 | 0.0% | 0% | 0% | 0.7% | 0% |
| UCA_L2_4 | 0.0% | 0% | ND | 0.0% | 0% |
| CUA Control | 1.3% | 4.0% | 2.7% | 3.1% | 6.5% |
| ACU Control | 2.6% | 2.4% | 5.5% | 5.0% | 2.6% |
| Shanghai Tech Control | 0.3% | 1.4% | 6.4% | 4.9% | 3.8% |

TABLE 5

Replicated editing results for remaining Cas12a CBE constructs

| Construct | Peak editing EMX1 | Peak editing RUNX1 Spacer 1 | Peak editing AAVS1 Spacer 1 | Peak editing DNMT1 Spacer 1 |
|---|---|---|---|---|
| ACU_L1_1 | 2.0% | 4.5% | 9.3% | 5.5% |
| ACU_L1_2 | 1.5% | 3.2% | 10.7% | 5.7% |
| ACU_L1_2 (A3A)* | 4.4% | 4.6% | 15.0% | ND |
| ACU_L1_3 | 0.8% | 2.8% | 7.3% | 5.4% |
| ACU_L1_3R | 4.1% | 5.6% | 9.4% | 10.3% |
| ACU_L1_5R | 2.8% | 4.8% | 12.3% | 6.7% |
| CUA_L1_1R_L2_3R | 1.7% | 3.2% | 8.3% | 4.0% |
| CUA_L1_3_L2_1 | 1.7% | 4.6% | 12.0% | 8.0% |
| UCA_L1_1 | 3.0% | 4.1% | 9.9% | 5.3% |
| UCA_L1_4 | 1.7% | 1.6% | 7.9% | 7.7% |
| UCA_L2_1 | 0.9% | 2.9% | 8.0% | 6.0% |
| UCA_L2_1R | 0.6% | 2.8% | 7.9% | 4.5% |
| UCA_L2_2 | 2.6% | 3.1% | 10.7% | 6.3% |
| UCA_L2_2R | 0% | 0% | 0% | 0.2% |
| UCA_L2_3 | 0% | 0.2% | 0.8% | 0.2% |
| UCA_L2_4 | 0% | 0% | 0.1% | 0% |
| CUA Control | 1.5% | 3.9% | 7.8% | 6.7% |
| ACU Control | 2.6% | 3.0% | 8.8% | 3.5% |
| Shanghai Tech Control | 1.1% | 1.6% | 7.7% | 5.2% |

*This construct was tested as a fusion to A3A rather than Apobec1.

Example 3

A subset of the designs, along with the three control constructs, were additionally tested as fusions to human A3A, a highly active deaminase that has been previously shown to enable efficient cytosine base editing. To stabilize these constructs, introns were included in the sequence of A3A. Two additional constructs, UCA_L2_2R and UCA_L2_4, were too unstable to purify as Apobec1 fusions without an intron and so are shown here as fusions with Apobec1 containing an intron in the coding region. For FIGS. 21-25, the Y axis indicates the C to T editing efficiency achieved at each of the cytosines indicated by the figure legend, and constructs are listed across the X axis with each cytosine within the spacer described by a different bar. When "ND" is indicated, it denotes that no data was collected for the specified sample and spacer.

The results for this example are provided in Table 6, below, and in FIGS. 21-25. Percentages in Table 6 indicates the maximum amount of C→T editing observed at any one base in the spacer indicated.

TABLE 6

| Construct | Peak editing EMX1 Spacer 1 | Peak editing AAVS1 Spacer 1 | Peak editing RUNX1 Spacer 1 | Peak editing RUNX1 Spacer 2 | Peak editing DNMT1 Spacer 1 |
|---|---|---|---|---|---|
| ACU_L1_2 (A3A)* | 11.1% | 4.2% | 6.1% | 7.4% | 6.3% |
| ACU_L1_2 (A3A + intron) | 7.1% | 7.9% | 6.4% | 8.4% | 9.7% |
| ACU_L1_3R | 13.3% | 6.7% | 5.1% | 6.4% | 6.0% |
| ACU_L1_3R (A3A + intron) | 8.1% | 9.1% | 10.5% | 9.5% | 7.7% |
| ACU_L1_5R | 3.9% | 5.1% | 3.5% | 5.3% | 6.3% |
| ACU_L1_5R (A3A + intron) | 30.2% | 14.6% | 18.6% | 18.0% | 18.6% |
| UCA_L2_1 (A3A + intron) | 24.3% | 14.4% | ND | 17.2% | 17.6% |
| UCA_L2_2R (Apobec1 + intron) | 3.8% | 4.3% | 3.2% | 3.9% | 6.8% |
| UCA_L2_4 (Apobec1 + intron) | 9.9% | 11.2% | 11.6% | ND | 9.4% |
| ACU Control (A3A + intron) | 15.3% | 14.1% | 14% | 11.6% | 13.9% |
| CUA Control | 4.6% | 3.9% | 4% | 4.3% | 4.1% |
| ACU Control | 11.5% | 8.1% | ND | 7.9% | 12.3% |
| Shanghai Tech Control | 11.2% | 8.6% | 4.8% | 6.1% | 9.7% |

*A3A = APOBEC3A

Example Editor Constructs

ACU_L1_5R A3A (HCF version): SEQ ID NOs:91, 93

ACU_L1_5R A3A (Soy version): SEQ ID NOs:92, 94

ACU_L1_2 A3A (HCF version): SEQ ID NOs:95, 96

ACU_L1_3R A3A (HCF version): SEQ ID NOs:97, 98

UCA_L2_1 A3A (HCF version): SEQ ID NOs:99, 100

CUA Control: SEQ ID NO:101

ACU Control: SEQ ID NO:102

Shanghai Tech Control: SEQ ID NO:103

ACU control A3A (HCF version): SEQ ID NO:104, 105

UCA_L2_2R (Apobec1+intron): SEQ ID NO:106

UCA_L2_4 (Apobec1+intron): SEQ ID NO:107

Example 4

R-SODA Protocol

For rapid stable soybean assays (R-SODA), rehydrated dried soybean explants were infiltrated with *Agrobacterium tumefaciens* containing plasmids encoding the appropriate constructs and guide cassettes in their T-DNAs using sonication. Explants were co-cultured with *A. tumefaciens* for four days and transferred to selection media. They were then cultured on selection media for four weeks, and shoots were collected for screening. Editing in each sampled shoot was assessed using next-generation sequencing.

Figure 26:
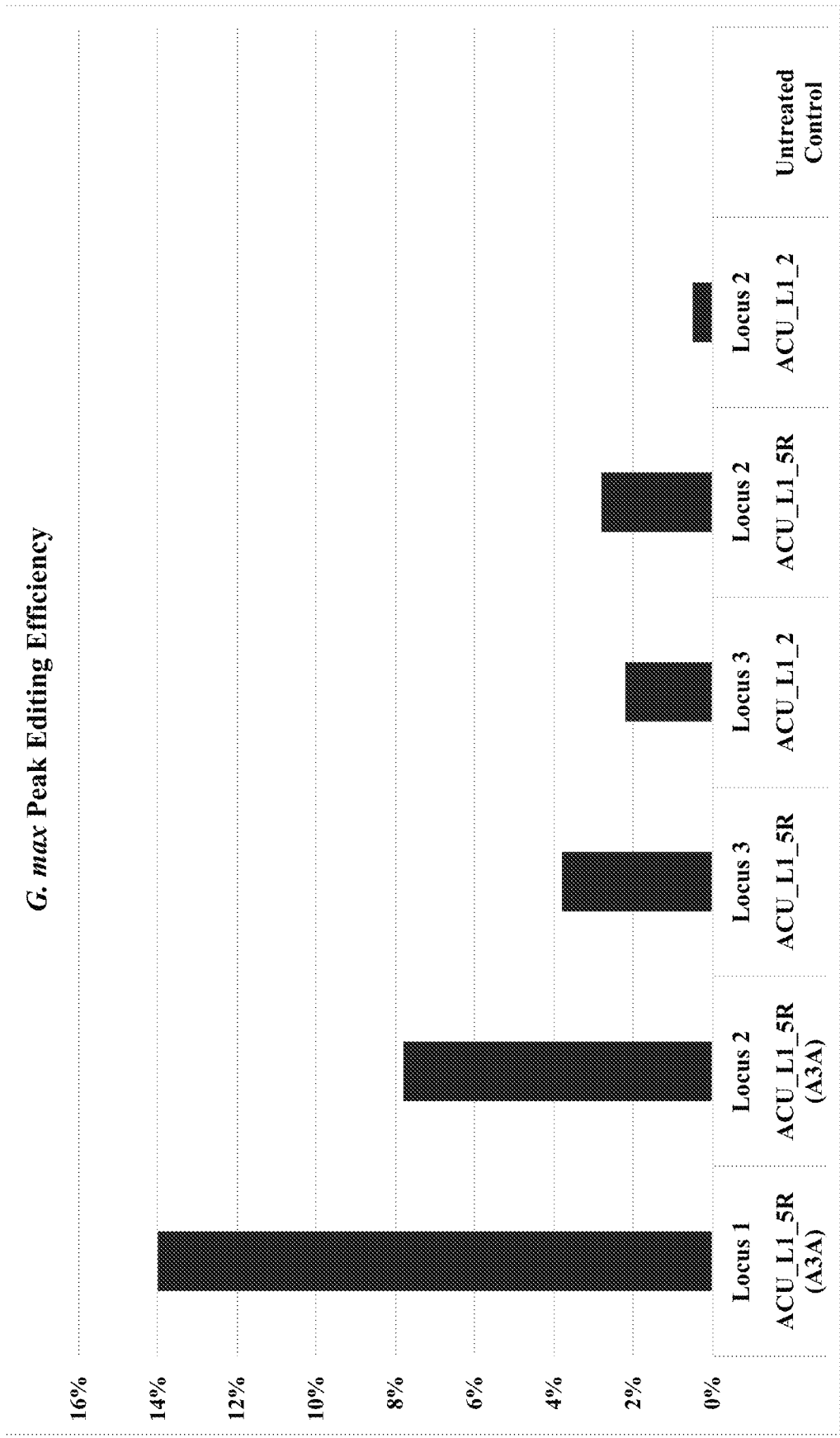
FIG. 26 shows the results of editing three different nucleic acid targets in soybean (locus 1, locus 2, locus 3) using editor constructs of the invention as described in Example 4.

Three different nucleic acid targets in soybean (locus 1, locus 2, locus 3) were edited using editor constructs of the invention (ACU_L1_5R (A3A), ACU_L1_5R, ACU_L1_2) The results are shown in FIG. 26.

The foregoing is illustrative of the present invention, and is not to be construed as limiting thereof. The invention is defined by the following claims, with equivalents of the claims to be included therein.

SEQUENCE LISTING (107 sequences)

SEQ ID NO: 1 - protein, 36 aa, Artificial
  linker
EKSKNDRSKPQPSDDRDRQPPSGEDYPEWKAPGEYE

SEQ ID NO: 2 - protein, 34 aa, Artificial
  linker
QEPKPQDQSSEVPPPPGSQKPGTKEPHDSKSSGP

SEQ ID NO: 3 - protein, 34 aa, Artificial
  linker
PDNSSGQKLQLPQPSDKPQDSREKSDSLPSDKRD

SEQ ID NO: 4 - protein, 36 aa, Artificial
  linker
PDNSTLQTLQLPQPTPSSTDTQQTSDTDPEDTTDVI

SEQ ID NO: 5 - protein, 30 aa, Artificial
  linker
STSQSDGSSVPADIDQSSDSDQSSSQGQPG

SEQ ID NO: 6 - protein, 14 aa, Artificial
  linker
AKPDDESQKPPQDD

SEQ ID NO: 7 - protein, 14 aa, Artificial
  linker
LQLEPGPTTPEYPI

SEQ ID NO: 8 - protein, 14 aa, Artificial
  linker
IQLPPSDTTPENPI

SEQ ID NO: 9 - protein, 12 aa, Artificial
  linker
ESNDNSQVPPSL

SEQ ID NO: 10 - protein, 10 aa, Artificial
  linker
SEQQEYPGSG

SEQ ID NO: 11 - protein, 10 aa, Artificial
  linker
NNSEQQENPA

SEQ ID NO: 12 - protein, 12 aa, Artificial
  linker
STDGSGQPKHKP

SEQ ID NO: 13 - protein, 20 aa, Artificial
  linker
PKPSSESGERYEQQPEPPPP

SEQ ID NO: 14 - protein, 16 aa, Artificial
  linker
KGGGGEPDEKRPSQSS

SEQ ID NO: 15 - protein, 14 aa, Artificial
  linker
YAGGTPKEPPPPNS

SEQ ID NO: 16 - protein, 14 aa, Artificial
  linker
PLVAGGTPFEPPPP

SEQ ID NO: 17 - protein, 14 aa, Artificial
  linker
PQPDERSQIPDNKE

SEQ ID NO: 18 - protein, 10 aa, Artificial
  linker
YTDEKPLPRS

SEQ ID NO: 19 - protein, 12 aa, Artificial
  linker
SHPPQEPPQSNL

SEQ ID NO: 20 - protein, 16 aa, Artificial
  linker
SESPSKQQPEPKSSKG

SEQ ID NO: 21 - protein, 16 aa, Artificial
  linker
SESPTNQQPEPQWTTD

SEQ ID NO: 22 - protein, 16 aa, Artificial
  linker
GGSKGPPPSPPPPQPE

SEQ ID NO: 23 - protein, 16 aa, Artificial
  linker
GPLPAPPPQPPPPQPN

SEQ ID NO: 24 - protein, 14 aa, Artificial
  linker
RPLPHDNNKQDYSK

SEQ ID NO: 25 - protein, 4 aa, Artificial
  linker
SGGS

SEQ ID NO: 26 - protein, 10 aa, Artificial
  linker
SGGSGGSGGS

SEQ ID NO: 27 - protein, 16 aa, Artificial
  linker
SGSETPGTSESATPES

SEQ ID NO: 28 - protein, 32 aa, Artificial
  linker
SGGSSGGSSGSETPGTSESATPESSGGSSGGS

SEQ ID NO: 29 - protein, 1227 aa, Unknown
  Lachnospiraceae bacterium
SKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 30 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 31 - protein, 1241 aa, Utyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEDARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 32 - protein, 1238 aa, Candidatus methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDIVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIDRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLRPVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 33 - protein, 1281 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLDKIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 34 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKVNYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 35 - protein, 1206 aa, Unknown
  Lachnospiraceae bacterium
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSVIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFDTQASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGLYLQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 36 - protein, 1233 aa, Unknown
  Lachnospiraceae bacterium
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKKLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 37 - protein, 1227 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIANINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIASNKEWLEYAQTSVKH

SEQ ID NO: 38 - protein, 1264 aa, Unknown
  Lachnospiraceae bacterium
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYNKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNPLNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDISGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 39 - protein, 1373 aa, Moraxella bovoculi
MLFQDFTHLYPLSKTVRFELFIDRTLEHIHAKNFLSQDETMADMHQKVKVILDDYHRDFIADMMGEVKLTKLAEFYDVYLKFRKNPKDDELQKAQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFKDINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQKDFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIQASQAFFGKFDKICYNADKDYFEFHIDYAKFTDKAKNSRQIWTICSHGDKRYVYDKTANQNKGAAKGINVNDILKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 40 - protein, 1352 aa, Unknown
  Parcubacteria bacterium
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITESKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKIKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 41 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 42 - protein, 1324 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIDALKGFYIEDGFENNVLTPLATLLSSLDKYNLNGIFIRNNEALSSLSQNVYRNFSIDEAIDAQNAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNKDDLNLSISSTEWLDFVREKPYLK

SEQ ID NO: 43 - protein, 1484 aa, Unknown
  Peregrinibacteria bacterium
  misc_feature (1073)..(1073): Xaa can be any naturally occurring amino acid
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAMIKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTWIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDXWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKK

SEQ ID NO: 44 - protein, 1245 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSISEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQHGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 45 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYQWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 46 - protein, 228 aa, Rattus norvegicus
SSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 47 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 48 - protein, 83 aa, Bacillus phage
TNLSDIIEKETGKQLVIQESILMLPEEVEEVIGNKPESDILVHTAYDESTDENVMLLTSDAPEYKPWALVIQDSNGENKIKML

SEQ ID NO: 49 - protein, 1596 aa, Artificial
  base editor fusion protein
MKRTADGSEFESPKKKRKVTNLSDIIEKETGKQLVIQESILMLPEEVEEVIGNKPESDILVHTAYDESTDENVMLLTSDAPEYKPWALVIQDSNGENKIKMLSGGSGGSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHDSPEIPGEPPPPIPPESSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 50 - protein, 1594 aa, Artificial
  base editor fusion protein
MKRTADGSEFESPKKKRKVTNLSDIIEKETGKQLVIQESILMLPEEVEEVIGNKPESDILVHTAYDESTDENVMLLTSDAPEYKPWALVIQDSNGENKIKMLSGGSGGSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHRPLPHDNNKQDYSKSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 51 - protein, 1596 aa, Artificial
  base editor fusion protein
MKRTADGSEFESPKKKRKVTNLSDIIEKETGKQLVIQESILMLPEEVEEVIGNKPESDILVHTAYDESTDENVMLLTSDAPEYKPWALVIQDSNGENKIKMLSGGSGGSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGPLPAPPPQPPPPQPNSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 52 - protein, 1596 aa, Artificial
  base editor fusion protein
MKRTADGSEFESPKKKRKVTNLSDIIEKETGKQLVIQESILMLPEEVEEVIGNKPESDILVHTAYDESTDENVMLLTSDAPEYKPWALVIQDSNGENKIKMLSGGSGGSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGGSKGPPPSPPPPQPESSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 53 - protein, 1596 aa, Artificial
  base editor fusion protein
MKRTADGSEFESPKKKRKVTNLSDIIEKETGKQLVIQESILMLPEEVEEVIGNKPESDILVHTAYDESTDENVMLLTSDAPEYKPWALVIQDSNGENKIKMLSGGSGGSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSESPTNQQPEPQWTTDSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 54 - protein, 1596 aa, Artificial
  base editor fusion protein
MKRTADGSEFESPKKKRKVTNLSDIIEKETGKQLVIQESILMLPEEVEEVIGNKPESDILVHTAYDESTDENVMLLTSDAPEYKPWALVIQDSNGENKIKMLSGGSGGSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSESPSKQQPEPKSSKGSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 55 - protein, 1598 aa, Artificial
  base editor fusion protein
MKRTADGSEFESPKKKRKVTNLSDIIEKETGKQLVIQESILMLPEEVEEVIGNKPESDILVHTAYDESTDENVMLLTSDAPEYKPWALVIQDSNGENKIKMLSHPPQEPPQSNLSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGSETPGTSESATPESSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 56 - protein, 1596 aa, Artificial
  base editor fusion protein
MKRTADGSEFESPKKKRKVTNLSDIIEKETGKQLVIQESILMLPEEVEEVIGNKPESDILVHTAYDESTDENVMLLTSDAPEYKPWALVIQDSNGENKIKMLYTDEKPLPRSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGSETPGTSESATPESSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 57 - protein, 1600 aa, Artificial
  base editor fusion protein
MKRTADGSEFESPKKKRKVTNLSDIIEKETGKQLVIQESILMLPEEVEEVIGNKPESDILVHTAYDESTDENVMLLTSDAPEYKPWALVIQDSNGENKIKMLPQPDERSQIPDNKESKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGSETPGTSESATPESSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 58 - protein, 1596 aa, Artificial
  base editor fusion protein
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSTDGSGQPKHKPTNLSDIIEKETGKQLVIQESILMLPEEVEEVIGNKPESDILVHTAYDESTDENVMLLTSDAPEYKPWALVIQDSNGENKIKMLVAGGTPFEPPPPNSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 59 - protein, 1598 aa, Artificial
  base editor fusion protein
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSTDGSGQPKHKPTNLSDIIEKETGKQLVIQESILMLPEEVEEVIGNKPESDILVHTAYDESTDENVMLLTSDAPEYKPWALVIQDSNGENKIKMLKGGGGEPDEKRPSQSSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 60 - protein, 1602 aa, Artificial
  base editor fusion protein
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSTDGSGQPKHKPTNLSDIIEKETGKQLVIQESILMLPEEVEEVIGNKPESDILVHTAYDESTDENVMLLTSDAPEYKPWALVIQDSNGENKIKMLPKPSSESGERYEQQPEPPPPSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 61 - protein, 1594 aa, Artificial
  base editor fusion protein
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSEQQENPGSGTNLSDIIEKETGKQLVIQESILMLPEEVEEVIGNKPESDILVHTAYDESTDENVMLLTSDAPEYKPWALVIQDSNGENKIKMLVAGGTPFEPPPPNSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 62 - protein, 1596 aa, Artificial
  base editor fusion protein
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSEQQENPGSGTNLSDIIEKETGKQLVIQESILMLPEEVEEVIGNKPESDILVHTAYDESTDENVMLLTSDAPEYKPWALVIQDSNGENKIKMLKGGGGEPDEKRPSQSSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 63 - protein, 1600 aa, Artificial
  base editor fusion protein
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSEQQENPGSGTNLSDIIEKETGKQLVIQESILMLPEEVEEVIGNKPESDILVHTAYDESTDENVMLLTSDAPEYKPWALVIQDSNGENKIKMLPKPSSESGERYEQQPEPPPPSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSKRTADGSEF

SEQ ID NO: 64 - protein, 1614 aa, Artificial
  base editor fusion protein
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHESNDNSQVPPSLTNLSDIIEKETGKQLVIQESILMLPEEVEEVIGNKPESDILVHTAYDESTDENVMLLTSDAPEYKPWALVIQDSNGENKIKMLSGGSKRTADGSEF

SEQ ID NO: 65 - protein, 1616 aa, Artificial
  base editor fusion protein
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHIQLPPSDTTPENPITNLSDIIEKETGKQLVIQESILMLPEEVEEVIGNKPESDILVHTAYDESTDENVMLLTSDAPEYKPWALVIQDSNGENKIKMLSGGSKRTADGSEF

SEQ ID NO: 66 - protein, 1616 aa, Artificial
  base editor fusion protein
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHLQLEPGPTTPEYPITNLSDIIEKETGKQLVIQESILMLPEEVEEVIGNKPESDILVHTAYDESTDENVMLLTSDAPEYKPWALVIQDSNGENKIKMLSGGSKRTADGSEF

SEQ ID NO: 67 - protein, 1616 aa, Artificial
  base editor fusion protein
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHAKPDDESQKPPQDDTNLSDIIEKETGKQLVIQESILMLPEEVEEVIGNKPESDILVHTAYDESTDENVMLLTSDAPEYKPWALVIQDSNGENKIKMLSGGSKRTADGSEF

SEQ ID NO: 68 - protein, 1610 aa, Artificial
  base editor fusion protein
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSTSQSDGSSVPADIDQSSDSDQSSSQGQPGSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEF

SEQ ID NO: 69 - protein, 1614 aa, Artificial
  base editor fusion protein
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKPDNSTLQTLQLPQPTPSSTDTQQTSDTDPEDTTDSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEF

SEQ ID NO: 70 - protein, 1614 aa, Artificial
  base editor fusion protein
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKPDNSSGQKLQLPQPSDKPQDSREKSDSLPSDKRDSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEF

SEQ ID NO: 71 - protein, 1614 aa, Artificial
  base editor fusion protein
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKQEPKPQDQSSEVPPPPGSQKPGTKEPHDSKSSGPSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEF

SEQ ID NO: 72 - protein, 1616 aa, Artificial
  base editor fusion protein
MKRTADGSEFESPKKKRKVSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKEKSKNDRSKPQPSDDRDRQPPSGEDYPEWKAPGEYESKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEF

SEQ ID NO: 73 - protein, 19 aa, Artificial
  RNA Spacer
NNNNNNNNNNNNNNNNNNN

SEQ ID NO: 74 - protein, 22 aa, Artificial
  Target strand
AAANNNNNNNNNNNNNNNNNNN

SEQ ID NO: 75 - protein, 22 aa, Artificial
  Non-target strand
TTTNNNNNNNNNNNNNNNNNNN

SEQ ID NO: 76 - DNA, 621 bp, Petromyzon marinus
acagatgcagagtatgtgagaattcacgaaaagctggacatctataccttcaagaagcagttctttaacaataagaagtctgtgagccataggtgctacgtgctgttcgagctgaagagaaggggtgaaagaagggcatgtttttgggggtatgctgtgaacaagccccagtctggaactgagagaggcattcacgccgaaattttcagcatcagaaaggtggaggaatacctgagggataaccctggacagtttacaattaattggtattctagctggtctccatgcgctgactgtgccgagaagatcctggaatggtacaaccaggagctgagaggaaatggccataccctgaagatttgggcctgcaagctgtactatgaaaagaacgcaagaaatcagatcggactgtggaacctgagggataatggtgtggggctgaacgtgatggtgtccgagcactatcagtgctgtagaaagattttcattcagtcctcacataatcagctgaacgagaatagatggctggaaaagactctgaagagggctgagaagagaaggtccgaactgtcaattatgatccaggtgaagatcctgcacaccactaagtcacctgccgtg

SEQ ID NO: 77 - protein, 160 aa, Artificial
  polypeptide
FERNYDPRELRKETYLLYEIKWGKSGKLWRHWCQNNRTQHAEVYFLENIFNARRFNPSTHCSITWYLSWSPCAECSQKIVDFLKEHPNVLEIYVARLYYHEDERNRQGLRDLVNSGVTIRIMDLPDYNYCWKTFVSDQGGDEDYWPGHFAPWIKQYSLKL

SEQ ID NO: 78 - protein, 207 aa, Artificial
  polypeptide
TDAEYVRIHEKLDIYTFKKQFSNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWVCKLYYEKNARNQIGLWNLRDNGVGLNVMVSEHYQCCRKIFIQSSHNQLNENRWLEKTLKRAEKRRSELSIMFQVKILHTTKSPAV

SEQ ID NO: 79 - protein, 228 aa, Artificial
  polypeptide
SSKTGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPNVTLFIYIARLYHLANPRNRQGLRDLISSGVTIQIMTEQESGYCWHNFVNYSPSNESHWPRYPHLWVRLYVLELYCIILGLPPCLNILRRKQSQLTSFTIALQSCHYQRLPPHILWATGLK

SEQ ID NO: 80 - protein, 162 aa, Artificial
  polypeptide
SFERNYDPRELRKETYLLYEIKWGKSGKLWRHWCQNNRTQHAEVYFLENIFNARRFNPSTHCSITWYLSWSPCAECSQKIVDFLKEHPNVNLEIYVARLYYPENERNRQGLRDLVNSGVTIRIMDLPDYNYCWKTFVSDQGGDEDYWPGHFAPWIKQYSLKL

SEQ ID NO: 81 - protein, 198 aa, Homo sapiens [sequence omitted]

SEQ ID NO: 82 - protein, 197 aa, Artificial
  polypeptide
MDSLLMNRREFLYQFKNVRWAKGRRETYLCYVVKRRDSATSFSLDFGYLRNKNGCHVELLFLRYISDWDLDPGRCYRVTWFISWSPCYDCARHVADFLRGNPNLSLRIFTARLYFCEDRKAEPEGLRRLHRAGVQIAIMTFKDYFYCWNTFVENHGRTFKAWEGLHENSVRLSRQLRRILLPLYEVDDLRDAFRTCT

SEQ ID NO: 83 - DNA, 23 bp, Artificial
  spacer
tcatctgtgcccctccctccctg

SEQ ID NO: 84 - DNA, 23 bp, Artificial
  spacer
agcctcacccctctagccctaca

SEQ ID NO: 85 - DNA, 23 bp, Artificial
  spacer
ttctcccctctgctggatacctc

SEQ ID NO: 86 - DNA, 23 bp, Artificial
  spacer
cctcactcctgctcggtgaattt

SEQ ID NO: 87 - DNA, 23 bp, Artificial
  spacer
gctcagcaggcacctgcctcagc

SEQ ID NO: 88 - DNA, 23 bp, Artificial
  spacer
tctgtcccctccaccccacagtg

SEQ ID NO: 89 - DNA, 133 bp, Homo sapiens
gtaagtatcaaggttacaagacaggtttaaggagaccaatagaaactgggcttgtcgagacagagaagactcttgcgtttctgataggcacctattggtcttactgacatccactttgcctttctctccacag

SEQ ID NO: 90 - DNA, 189 bp, Glycine max
gtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgaagtgcag

SEQ ID NO: 91 - protein, 1591 aa, Artificial
  fusion protein
MKRTADGSEFESPKKKRKVEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNSTSQSDGSSVPADIDQSSDSDQSSSQGQPGSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKVGSG

SEQ ID NO: 92 - protein, 1570 aa, Artificial
  fusion protein
MAGSKKRRIKQDEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNSTSQSDGSSVPADIDQSSDSDQSSSQGQPGSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLGSKKRRIKQD

SEQ ID NO: 93 - DNA, 4906 bp, Artificial
  polynucleotide
atgaaacggacagccgacggaagcgagttcgagtcaccaaagaagaagcggaaagtcgaggcctcccccgcatcaggacctagacacctgatggatccccatattttcacatctaacttcaacaacggaatcggcagacacaagacctacctgtgctatgaggtggaaaggctggataacggaacctctgtgaagatggaccagcacaggtaagtatcaaggttacaagacaggtttaaggagaccaatagaaactgggcttgtcgagacagagaagactcttgcgtttctgataggcacctattggtcttactgacatccactttgcctttctctccacaggggcttcctgcataaccaggccaagaatctgctgtgcggtttctacgggagacatgcagaactgaggtttctggatctggtgccatccctgcagctggaccccgctcagatctacagagtgacttggttcatctcttggagcccttgcttttcatggggatgtgctggcgaggtgagggccttccttcaggaaaacacacacgtgagactgaggatttttgctgccagaatctacgattatgacccactgtacaaggaagctctgcagatgctgagggatgcaggcgctcaggtgagcattatgacctatgacgaattcaagcactgctgggatacttttgtggaccatcagggttgtccttttcagccatgggatgggctggacgagcattctcaggcactgagcggtagactgagggctatcctgcagaaccaggggaattctacttctcaatctgatggatcttctgttccagctgatattgatcaatcttctgattctgatcaatcttcttctcaaggacaaccaggatccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaggagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgccaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactcaggcggaagtggtggaagtggcggtagtaccaacctcagcgacattatcgagaaggaaaccggcaagcaactcgtgatccaggagagcatactgatgctccccgaggaggtcgaggaggtgattggcaataagcccgagtccgatatactggttcatactgcgtatgacgaaagcacagacgagaacgtcatgctacttaccagcgacgccccggagtacaagccctgggccctagtcatccaagacagcaacggtgagaacaagatcaagatgctttctggcggctcaaaaagaaccgccgacggcagcgaattcgagcccaagaagaagaggaaagtcggaagcgga

SEQ ID NO: 94 - DNA, 5091 bp, Artificial
  polynucleotide
atggcgggatctaagaagagaagaattaaacaagatgaggcatctcctgcgtctggtccaaggcacttgatggatccacatattttcacttcaaacttcaacaatggcattgggagacacaagacctacttgtgctatgaggttgaaagattggacaatggaacttctgtaaagatggaccaacatagaggatttctccacaaccaagccaaaaatcttctgtgtggcttctatggtcgtcatgctgagcttaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgaagtgcaggttcctcgaccttgtcccaagtcttcagctggatcctgcccagatctacagggtgacgtggtttatctcttggagtccctgtttttcatggggatgtgctggtgaagtgagagcatttcttcaagaaaatactcatgttcgcttgaggatttttgctgctcgaatatatgattatgaccctctctacaaggaagctttacaaatgttacgtgatgcaggggcacaagtttcaataatgacatatgatgaattcaaacattgctgggacacatttgttgatcatcaaggttgcccctttcagccttgggatggtttggatgagcactctcaagcactgagtggaagactacgggccatactacaaaatcaaggaaattccacctctcagagtgatgggagcagcgtgccggctgatattgatcaatcatcagattctgatcagtcgtccagccagggacagccaggctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgccaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactccggtggttctggtgggagtgggggctcgacaaatctctctgacatcattgagaaagaaactggaaaacaattggtgattcaggaatcaatattgatgcttcctgaagaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgaagtgcaggttgaagaggtcattggaaacaaacctgagagtgacatacttgttcataccgcctatgatgagagcactgatgaaaatgtgatgctgctcacatctgatgctcccgagtacaagccatgggcattagtaattcaagattcaaatggagaaaacaagatcaagatgttgggatctaagaagagaagaattaaacaagattga

SEQ ID NO: 95 - protein, 1595 aa, Artificial
  fusion protein
MKRTADGSEFESPKKKRKVEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNQEPKPQDQSSEVPPPPGSQKPGTKEPHDSKSSGPSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKVGSG

SEQ ID NO: 96 - DNA, 4918 bp, Artificial
  polynucleotide
atgaaacggacagccgacggaagcgagttcgagtcaccaaagaagaagcggaaagtcgaggcctcccccgcatcaggacctagacacctgatggatccccatattttcacatctaacttcaacaacggaatcggcagacacaagacctacctgtgctatgaggtggaaaggctggataacggaacctctgtgaagatggaccagcacaggtaagtatcaaggttacaagacaggtttaaggagaccaatagaaactgggcttgtcgagacagagaagactcttgcgtttctgataggcacctattggtcttactgacatccactttgcctttctctccacaggggcttcctgcataaccaggccaagaatctgctgtgcggtttctacgggagacatgcagaactgaggtttctggatctggtgccatccctgcagctggaccccgctcagatctacagagtgacttggttcatctcttggagcccttgcttttcatggggatgtgctggcgaggtgagggccttccttcaggaaaacacacacgtgagactgaggatttttgctgccagaatctacgattatgacccactgtacaaggaagctctgcagatgctgagggatgcaggcgctcaggtgagcattatgacctatgacgaattcaagcactgctgggatacttttgtggaccatcagggttgtccttttcagccatgggatgggctggacgagcattctcaggcactgagcggtagactgagggctatcctgcagaaccaggggaatcaagaaccaaagccacaagatcaatcttctgaagttccaccaccaccaggatctcaaaagccaggaactaaggaaccacatgattctaagtcttctggaccatccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaggagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgccaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactcaggcggaagtggtggaagtggcggtagtaccaacctcagcgacattatcgagaaggaaaccggcaagcaactcgtgatccaggagagcatactgatgctccccgaggaggtcgaggaggtgattggcaataagcccgagtccgatatactggttcatactgcgtatgacgaaagcacagacgagaacgtcatgctacttaccagcgacgccccggagtacaagccctgggccctagtcatccaagacagcaacggtgagaacaagatcaagatgctttctggcggctcaaaaagaaccgccgacggcagcgaattcgagcccaagaagaagaggaaagtcggaagcgga

SEQ ID NO: 97 - protein, 1595 aa, Artificial
  fusion protein
MKRTADGSEFESPKKKRKVEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNPDNSTLQTLQLPQPTPSSTDTQQTSDTDPEDTTDSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKVGSG

SEQ ID NO: 98 - DNA, 4918 bp, Artificial
  polynucleotide
atgaaacggacagccgacggaagcgagttcgagtcaccaaagaagaagcggaaagtcgaggcctcccccgcatcaggacctagacacctgatggatccccatattttcacatctaacttcaacaacggaatcggcagacacaagacctacctgtgctatgaggtggaaaggctggataacggaacctctgtgaagatggaccagcacaggtaagtatcaaggttacaagacaggtttaaggagaccaatagaaactgggcttgtcgagacagagaagactcttgcgtttctgataggcacctattggtcttactgacatccactttgcctttctctccacaggggcttcctgcataaccaggccaagaatctgctgtgcggtttctacgggagacatgcagaactgaggtttctggatctggtgccatccctgcagctggaccccgctcagatctacagagtgacttggttcatctcttggagcccttgcttttcatggggatgtgctggcgaggtgagggccttccttcaggaaaacacacacgtgagactgaggatttttgctgccagaatctacgattatgacccactgtacaaggaagctctgcagatgctgagggatgcaggcgctcaggtgagcattatgacctatgacgaattcaagcactgctgggatacttttgtggaccatcagggttgtccttttcagccatgggatgggctggacgagcattctcaggcactgagcggtagactgagggctatcctgcagaaccaggggaatccagataactctactcttcaaactcttcaacttccacaaccaactccatcttctactgatactcaacaaacttctgatactgatccagaagatactactgattccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaggagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgccaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactcaggcggaagtggtggaagtggcggtagtaccaacctcagcgacattatcgagaaggaaaccggcaagcaactcgtgatccaggagagcatactgatgctccccgaggaggtcgaggaggtgattggcaataagcccgagtccgatatactggttcatactgcgtatgacgaaagcacagacgagaacgtcatgctacttaccagcgacgccccggagtacaagccctgggccctagtcatccaagacagcaacggtgagaacaagatcaagatgctttctggcggctcaaaaagaaccgccgacggcagcgaattcgagcccaagaagaagaggaaagtcggaagcgga

SEQ ID NO: 99 - protein, 1577 aa, Artificial
  fusion protein
MKRTADGSEFESPKKKRKVTNLSDIIEKETGKQLVIQESILMLPEEVEEVIGNKPESDILVHTAYDESTDENVMLLTSDAPEYKPWALVIQDSNGENKIKMLSGGSGGSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSESPSKQQPEPKSSKGEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNSGGSKRTADGSEFEPKKKRKVGSG

SEQ ID NO: 100 - DNA, 4864 bp, Artificial
  polynucleotide
atgaaacggacagccgacggaagcgagttcgagtcaccaaagaagaagcggaaagtcaccaacctcagcgacattatcgagaaggaaaccggcaagcaactcgtgatccaggagagcatactgatgctccccgaggaggtcgaggaggtgattggcaataagcccgagtccgatatactggttcatactgcgtatgacgaaagcacagacgagaacgtcatgctacttaccagcgacgccccggagtacaagccctgggccctagtcatccaagacagcaacggtgagaacaagatcaagatgcttagtggcgggtccggtgggtccggtggtagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaggagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgccaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactctgaatctccatctaagcaacaaccagaaccaaagtcttctaagggagaggcctcccccgcatcaggacctagacacctgatggatccccatattttcacatctaacttcaacaacggaatcggcagacacaagacctacctgtgctatgaggtggaaaggctggataacggaacctctgtgaagatggaccagcacaggtaagtatcaaggttacaagacaggtttaaggagaccaatagaaactgggcttgtcgagacagagaagactcttgcgtttctgataggcacctattggtcttactgacatccactttgcctttctctccacaggggcttcctgcataaccaggccaagaatctgctgtgcggtttctacgggagacatgcagaactgaggtttctggatctggtgccatccctgcagctggaccccgctcagatctacagagtgacttggttcatctcttggagcccttgcttttcatggggatgtgctggcgaggtgagggccttccttcaggaaaacacacacgtgagactgaggatttttgctgccagaatctacgattatgacccactgtacaaggaagctctgcagatgctgagggatgcaggcgctcaggtgagcattatgacctatgacgaattcaagcactgctgggatacttttgtggaccatcagggttgtccttttcagccatgggatgggctggacgagcattctcaggcactgagcggtagactgagggctatcctgcagaaccaggggaattctggcggctcaaaaagaaccgccgacggcagcgaattcgagcccaagaagaagaggaaagtcggaagcgga

SEQ ID NO: 101 - protein, 1558 aa, Artificial
  polypeptide
SKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLSGGSGGSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 102 - protein, 1580 aa, Artificial
  polypeptide
SSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKML

SEQ ID NO: 103 - protein, 1573 aa, Artificial
  polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSPKKKRKVSGGSTNLSDIIEKETGKQLVIQESILMLPEEVEEVIGNKPESDILVHTAYDESTDENVMLLTSDAPEYKPWALVIQDSNGENKIKMLTKYD

SEQ ID NO: 104 - protein, 1593 aa, Artificial
  fusion protein
MKRTADGSEFESPKKKRKVEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGNSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHSGGSGGSGGSTNLSDIIEKETGKQLVIQESILMLPEEVEEVIGNKPESDILVHTAYDESTDENVMLLTSDAPEYKPWALVIQDSNGENKIKMLSGGSKRTADGSEFEPKKKRKVGSG

SEQ ID NO: 105 - DNA, 4912 bp, Artificial
  polynucleotide
atgaaacggacagccgacggaagcgagttcgagtcaccaaagaagaagcggaaagtcgaggcctcccccgcatcaggacctagacacctgatggatccccatattttcacatctaacttcaacaacggaatcggcagacacaagacctacctgtgctatgaggtggaaaggctggataacggaacctctgtgaagatggaccagcacaggtaagtatcaaggttacaagacaggtttaaggagaccaatagaaactgggcttgtcgagacagagaagactcttgcgtttctgataggcacctattggtcttactgacatccactttgcctttctctccacaggggcttcctgcataaccaggccaagaatctgctgtgcggtttctacgggagacatgcagaactgaggtttctggatctggtgccatccctgcagctggaccccgctcagatctacagagtgacttggttcatctcttggagcccttgcttttcatggggatgtgctggcgaggtgagggccttccttcaggaaaacacacacgtgagactgaggatttttgctgccagaatctacgattatgacccactgtacaaggaagctctgcagatgctgagggatgcaggcgctcaggtgagcattatgacctatgacgaattcaagcactgctgggatacttttgtggaccatcagggttgtccttttcagccatgggatgggctggacgagcattctcaggcactgagcggtagactgagggctatcctgcagaaccaggggaatagtggcggtagctcaggtggtagttcaggtagcgagaccccgggtacatccgagtcagcaacacctgagtcaagcggcggtagttcaggtggctcctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaggagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgccaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactcaggcggaagtggtggaagtggcggtagtaccaacctcagcgacattatcgagaaggaaaccggcaagcaactcgtgatccaggagagcatactgatgctccccgaggaggtcgaggaggtgattggcaataagcccgagtccgatatactggttcatactgcgtatgacgaaagcacagacgagaacgtcatgctacttaccagcgacgccccggagtacaagccctgggccctagtcatccaagacagcaacggtgagaacaagatcaagatgctttctggcggctcaaaaagaaccgccgacggcagcgaattcgagcccaagaagaagaggaaagtcggaagcgga

SEQ ID NO: 106 - DNA, 4954 bp, Artificial
  polynucleotide
atgaaacggacagccgacggaagcgagttcgagtcaccaaagaagaagcggaaagtcaccaacctcagcgacattatcgagaaggaaaccggcaagcaactcgtgatccaggagagcatactgatgctccccgaggaggtcgaggaggtgattggcaataagcccgagtccgatatactggttcatactgcgtatgacgaaagcacagacgagaacgtcatgctacttaccagcgacgccccggagtacaagccctgggccctagtcatccaagacagcaacggtgagaacaagatcaagatgcttagtggcgggtccggtgggtccggtggtagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaggagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgccaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacggaccacttccagctccaccaccacaaccaccaccaccacaaccaaactcaagtgaaacgggcccggtcgcggtggaccccacgctccgacggcgtatcgagccccacgagttcgaggtgtttttcgacccgcgcgagcttcgtaaggaaacctgcttgctttacgagatcaactggggaggacggcactccatctggcggcacacctcgcagaacaccaacaagcacgtcgaggtcaactttatcgagaaattcacaaccgagcgctacttctgccccaacacacggtgttcaatcacatggttcctgagctggtcgccttgcggagagtgctcacgcgccatcacggagttcctgtctcgctacccgcacgtcaccctctttatctatatcgcacgcctctaccaccacgccgatccgcgtaatcgccaggtaagtatcaaggttacaagacaggtttaaggagaccaatagaaactgggcttgtcgagacagagaagactcttgcgtttctgataggcacctattggtcttactgacatccactttgcctttctctccacaggggttgcgcgacctaatctcatccggcgtaaccattcagatcatgaccgaacaagaatctggttactgctggaggaatttcgtaaactactccccgtcgaacgaggcccactggccccgctatccccacctttgggtgcgcctttacgtgctggagctgtactgcatcatactcggtcttcctccttgcctgaacatccttcggcgaaagcagccgcagttgactttcttcaccattgcacttcaaagctgccactaccagcgcctccctccacatattctctgggcgaccggcttgaagtctggcggctcaaaaagaaccgccgacggcagcgaattcgagcccaagaagaagaggaaagtcggaagcgga

SEQ ID NO: 107 - DNA, 4954 bp, Artificial
  polynucleotide
atgaaacggacagccgacggaagcgagttcgagtcaccaaagaagaagcggaaagtcaccaacctcagcgacattatcgagaaggaaaccggcaagcaactcgtgatccaggagagcatactgatgctccccgaggaggtcgaggaggtgattggcaataagcccgagtccgatatactggttcatactgcgtatgacgaaagcacagacgagaacgtcatgctacttaccagcgacgccccggagtacaagccctgggccctagtcatccaagacagcaacggtgagaacaagatcaagatgcttagtggcgggtccggtgggtccggtggtagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaggagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgccaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacgattctccagaaattccaggagaaccaccaccaccaattccaccagaatcaagtgaaacgggcccggtcgcggtggaccccacgctccgacggcgtatcgagccccacgagttcgaggtgtttttcgacccgcgcgagcttcgtaaggaaacctgcttgctttacgagatcaactggggaggacggcactccatctggcggcacacctcgcagaacaccaacaagcacgtcgaggtcaactttatcgagaaattcacaaccgagcgctacttctgccccaacacacggtgttcaatcacatggttcctgagctggtcgccttgcggagagtgctcacgcgccatcacggagttcctgtctcgctacccgcacgtcaccctctttatctatatcgcacgcctctaccaccacgccgatccgcgtaatcgccaggtaagtatcaaggttacaagacaggtttaaggagaccaatagaaactgggcttgtcgagacagagaagactcttgcgtttctgataggcacctattggtcttactgacatccactttgcctttctctccacaggggttgcgcgacctaatctcatccggcgtaaccattcagatcatgaccgaacaagaatctggttactgctggaggaatttcgtaaactactccccgtcgaacgaggcccactggccccgctatccccacctttgggtgcgcctttacgtgctggagctgtactgcatcatactcggtcttcctccttgcctgaacatccttcggcgaaagcagccgcagttgactttcttcaccattgcacttcaaagctgccactaccagcgcctccctccacatattctctgggcgaccggcttgaagtctggcggctcaaaaagaaccgccgacggcagcgaattcgagcccaagaagaagaggaaagtcggaagcgga

That which is claimed is:

1. A Type V Clustered Regularly Interspaced Short Palindromic Repeats (CRISPR)-associated (Cas) (CRISPR-Cas) system comprising:
   (a) a fusion protein comprising a Cas12a domain, a linker comprising an amino acid sequence of any one of SEQ ID NOs:1-24, and a polypeptide of interest, wherein the Cas12a domain is linked to the polypeptide of interest via any one of the amino acid sequences of SEQ ID NOs: 1-24, or a nucleic acid encoding the fusion protein; and
   (b) a guide nucleic acid comprising a spacer sequence and a repeat sequence, wherein the guide nucleic acid is capable of forming a complex with the Cas12a domain of the fusion protein and the spacer sequence is capable of hybridizing to a target nucleic acid, thereby guiding the Cas12a domain and the polypeptide of interest to the target nucleic acid, whereby the system is capable of modifying or modulating the target nucleic acid.

2. The system of claim 1, wherein the Cas12a domain comprises a mutation in the nuclease active site.

3. The system of claim 1, wherein the Cas12a domain is linked at its C-terminus and/or its N-terminus to any one of the amino acid sequences of SEQ ID NOs: 1-24.

4. The system of claim 1, wherein the Cas12a domain is linked by its C-terminus to the N-terminus of the polypeptide of interest via any one of the amino acid sequences of SEQ ID NOs: 1-24.

5. The system of claim 1, wherein the Cas12a domain is linked by its N-terminus to the C-terminus the polypeptide of interest via any one of the amino acid sequences of SEQ ID NOs: 1-24.

6. The system of claim 1, wherein the polypeptide of interest comprises at least one polypeptide or protein domain having deaminase activity, nickase activity, recombinase activity, transposase activity, methylase activity, glycosylase activity, glycosylase inhibitor activity, demethylase activity, transcription activation activity, transcription repression activity, transcription release factor activity, histone modification activity, nuclease activity, single-strand RNA cleavage activity, double-strand RNA cleavage activity, restriction endonuclease activity, nucleic acid binding activity, methyltransferase activity, DNA repair activity, DNA damage activity, dismutase activity, alkylation activity, depurination activity, oxidation activity, pyrimidine dimer forming activity, integrase activity, transposase activity, polymerase activity, ligase activity, helicase activity, and/or photolyase activity.

7. The system of claim 1, wherein the polypeptide of interest comprises a cytosine deaminase domain.

8. The system of claim 7, wherein the cytosine deaminase domain is an apolipoprotein B mRNA editing catalytic polypeptide-like (APOBEC) domain.

9. The system of claim 8, wherein the APOBEC domain is APOBEC1 or APOBEC3A.

10. The system of claim 7, further comprising a uracil DNA glycosylase inhibitor (UGI) domain, wherein the C-terminus of the cytosine deaminase domain is linked to the N-terminus of the Cas12a domain via any one of the amino acid sequences of SEQ ID NOs:1-5 and the C-terminus of the Cas12a domain is linked to the N-terminus of the UGI domain, or the C-terminus of the Cas12a domain is linked to the N-terminus of the UGI domain via any one of the amino acid sequences of SEQ ID NOs:6-9 and the C-terminus of the cytosine deaminase domain is linked to the N-terminus of the Cas12a domain.

11. The system of claim 10, wherein the Cas12a domain comprises a mutation in the nuclease active site.

12. The system of claim 10, wherein the cytosine deaminase domain is an apolipoprotein B mRNA editing catalytic polypeptide-like (APOBEC) domain.

13. The system of claim 12, wherein the APOBEC domain is a rat or a human APOBEC domain, optionally wherein the rat APOBEC domain is the amino acid sequence of SEQ ID NO:46 and/or the APOBEC domain is the amino acid sequence of SEQ ID NO:47.

14. A cell comprising the system of claim 10, optionally wherein the cell is from an animal, a plant, a fungus, an archaeon, or a bacterium.

15. A method of editing a target nucleic acid, comprising contacting a cell or a cell free system comprising the target nucleic acid with the system of claim 7 under conditions wherein the fusion protein is expressed and forms a complex with the guide nucleic acid, the complex hybridizing to the target nucleic acid, wherein the cytosine deaminase domain converts a cytosine (C) to a thymine (T) in the target nucleic acid, thereby editing the target nucleic acid.

16. The system of claim 1, further comprising a second polypeptide of interest, wherein the second polypeptide of interest is a uracil-DNA glycosylase inhibitor (UGI).

17. The system of claim 16, further comprising a cytosine deaminase domain, wherein the C-terminus of the Cas12a domain is linked to the N-terminus of the UGI domain via any one of the amino acid sequences of SEQ ID NOs:10-12 and the C-terminus of the UGI domain is linked to the N-terminus of the cytosine deaminase domain via any one of the amino acid sequences of SEQ ID NOs:13-16.

18. A cell comprising the system of claim 17, optionally wherein the cell is from an animal, a plant, a fungus, an archaeon, or a bacterium.

19. The system of claim 16, further comprising a cytosine deaminase domain, wherein the Cas12a domain comprises a mutation in the nuclease active site and
   (a) the C-terminus of the UGI domain is linked to the N-terminus of the Cas12a domain via any one of the amino acid sequences of SEQ ID NOs:17-19 and the C-terminus of the Cas12a domain is linked to the N-terminus of the cytosine deaminase domain, or (b) the C-terminus of the UGI domain is linked to the N-terminus of the Cas12a domain and the C-terminus of the Cas12a domain is linked to the N-terminus of the cytosine deaminase domain via any one of the amino acid sequences of SEQ ID NOs:20-24.

20. A cell comprising the system of claim 19, optionally wherein the cell is from an animal, a plant, a fungus, an archaeon, or a bacterium.

21. The system of claim 1, wherein the nucleic acid encoding the fusion protein of (a) and guide nucleic acid of (b) are comprised in one or more expression cassettes and/or vectors.

22. The system of claim 1, wherein the fusion protein comprises an amino acid sequence of any one of SEQ ID NOs:49-72 or SEQ ID NOs:91-100, 106, or 107.

23. A cell comprising the system of claim 1, optionally wherein the cell is from an animal, a plant, a fungus, an archaeon, or a bacterium.

\* \* \* \* \*

UNITED STATES PATENT AND TRADEMARK OFFICE
CERTIFICATE OF CORRECTION

PATENT NO. : 11,708,568 B2
APPLICATION NO. : 17/354220
DATED : July 25, 2023
INVENTOR(S) : Guffy et al.

It is certified that error appears in the above-identified patent and that said Letters Patent is hereby corrected as shown below:

In the Specification

Column 19, Line 65: Please correct "Cas" to read --Cas12a--

Signed and Sealed this
Nineteenth Day of September, 2023

Katherine Kelly Vidal
*Director of the United States Patent and Trademark Office*